United States Patent 7,745,391 (HUMAN THROMBOSPONDIN POLYPEPTIDE) - sequence listing, part 79

SEQ ID NO: 280862 - DNA, 921 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcggggccttgtacgtacaaggccccgtggggtgttgcagagaagtgaattctcattaggtcccttatgtgtaggtggttgaaaagatgttgatctcggagtcaaatgtgtgatcatgtagaacgcagtggcagtgggatggttatctgtcagcgtaaggtatgggtgcgcagtgtaaggtgaaatatctccatacagaagaggagcggtactg

SEQ ID NO: 280863 - DNA, 2055 bp, Homo sapiens
cgtacaaggcccgctggcgtgaagccggccccttacattttgcgaagtgcattatatgtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcggcccccgccctctcctaggcctggcccggcagagcccccagagtggaccccccagcgactggggtcttctccccactcctccctccttctggtctgatgcggcagtgcgggggccttgtacgcgtacaaggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtg

SEQ ID NO: 280864 - DNA, 518 bp, Homo sapiens
ggcggcggctgaggcaaggggtgggcggggggcgcagcaggcccggcaaatcacggcccggcagcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaacgtaagttagcaaaaatagtttcaacagctctagcttgactctgctatgctacattgttatggatgatctctgacatcttacgtcttattaaaatcattataatcagttatataaaattgccaaagttaataatgtatttttgttaatgtaaatagttttcatgatagaagtctttatgactaaaagcgtatctttgcttttgaatgtcatttgtgtttctgcttaaatg

SEQ ID NO: 280865 - DNA, 1400 bp, Homo sapiens
tgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtctcccgccccccagtgtcctgaggctgggagggcattaacagaaaccacctgacacacagcaggtgcccagtttgtgcccacagacaaagcacggggactgcagaggagacccacagagctctctagggagggtttgtgaggaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280866 - DNA, 1058 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgtgagtgctgccgcgggaaggctgtgggggatgaggcctggcgcg

SEQ ID NO: 280867 - DNA, 1608 bp, Homo sapiens
tgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtctcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgactctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctc

SEQ ID NO: 280868 - DNA, 1898 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280869 - DNA, 2307 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaagagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280870 - DNA, 2105 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280871 - DNA, 1163 bp, Homo sapiens
gacccacgcgtccggacccacgcgtccgactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280872 - DNA, 1868 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280873 - DNA, 1026 bp, Homo sapiens
gcgcaccccttgcccgtgatacaggagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280874 - DNA, 1574 bp, Homo sapiens
cccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaagagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280875 - DNA, 1777 bp, Homo sapiens
tgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtctcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280876 - DNA, 1587 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagagcgcgcgctctggctgccgtgcggaggagctggatctgggagaggctgcgggcagggagtccagttaggaggctgggaccgcagcccagatgggtggaccccgatgcctgtggaggcgtgactcctggcggtctgggtggg

SEQ ID NO: 280877 - DNA, 1592 bp, Homo sapiens
  misc_feature (1592)..(1592): n is a, c, g, or t
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagagcgcgcgctctggctgccgtgcggaggagctggatctgggagaggctgcgggcagggagtccagttaggaggctgggaccgcagcccagatggcgggtgggacccccagatgccctgtgggagggcagtgacttccctggccgggn

SEQ ID NO: 280878 - DNA, 512 bp, Homo sapiens
gacctcacgggacgtgaagaaggacaacaagaggcagtccctcccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280879 - DNA, 721 bp, Homo sapiens
gggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280880 - DNA, 2015 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280881 - DNA, 2217 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280882 - DNA, 1856 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280883 - DNA, 1950 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 280884 - DNA, 1520 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgatggcggtgggaccccccgactgccctgtgggagggccgctgaccttccctggccggggttctggggctggggtcgggacaaccctgacccccctcccacggtttaaagaaagcgagagagacggaatcaggagcaacccgaaagagagacgctgatgtagaaggaagataagcaagaagcgcccattggcc

SEQ ID NO: 280885 - DNA, 2279 bp, Homo sapiens
cagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaaaaaaaaaaacctcgagaacttagtttctcttcttcttccacttatggtgggtctttccttttccccttcaagagcagggagcaattggttccccttgagcattctggggctccactctgacccagggggccttgcttggtgagaaacaggggggtccctttcaaatacattagtgggataggctaatcccatagggaattttcattagaattttgggaaccaggatgtattggaaggaagataatatataacctccttatggtgagggaaatggctactaattatcttgacacagttgaacgcattgctagggatttaaaccctcttacgtggccccctagccatttatacccgttcgtgcaaagggtacatttcacacctcttgtcacactggggcttgcacatcctccagagacatcgtgagctccccctaaattctccataccctgggtcgggacagcagcacttccatgaattgcacacccacatagagagatataaatacatccgcaccaaatcatagtgaccccggtgtcactacatttggggcgccttattcacaaatggcgccccttgaacgcccctgcggctcgttcagaagctgacccctagacacgagtgtgcacaagccagggtttaactctgacaactcacgtaccacgggcatattgtgtgagtacaggcatctcgttaaccacaaggcccggacagcctagcggcagcacaccacgtgcgacagtggaggtcgtgcaccagtgagtgtccttgcccgccccgtctgctcccgtcccgctcgcatttctgtcttgtcgaatcaaggagaacagtatgaccgcaagtcgatcaagagaagcacagcagacagcagaagcatgaccgacactactcgcagcgacagctacaacagacaagacgtcgaggaccggcagcacacagcaaaagcagaaaaacaacacagagggaagggaaaagaggagagaggcggagaacaagcagaaacggcggcacaggcagagggaagagaagaccgcagcgggagaaagggagagagggggaaacaggagaacaggaagaagggagaggcaagacggaaggaacagagagaggaggacaaaagagcgaggcaatcgaagagaacgaaggacacaaggagagcaaagaagacaggagaggagcggaagagcacgcgacacgaacgacaaacacgaacacagcagcaagaaggcgagaacgagcacggagtagggcgacgaagaagaacagaggaaagacgagagcacggagagagaggcccaagccacgaag

SEQ ID NO: 280886 - DNA, 899 bp, Homo sapiens
tgagctcggtacccctacatttgcaggaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacaaaaaaaaaaaaagaaccgaaatcactaacgcactacacaacgcgcacaatgtgtgtgggccactcggggccccggaaaagagttccttaaagccacctttggtggtgggccgagcggcccccaagatagtggatgtaagcaacggggccacaaagaggtgttcccgagagagagactcggggtagaaaaaaggggcgtgggatttcccccccataaaaaaaacgccccggggggaaaacccagacggttttcgaaaaaccccccaaaaggggctcagggggcacacagggggggctctcaaaaggagccacaggaacccgtttaat

SEQ ID NO: 280887 - DNA, 455 bp, Homo sapiens
  misc_feature (432)..(432): n is a, c, g, or t
aatgtaaaagactctgtctttcttctaaaaattagaagatagttgttaaagaaaatttaccttataaccttgttgagcatggtcaaaacttgctgattatatattcctaagcatcaagaattctatatggttcttttttcactgtatttcccttatttgtcaatagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttgacagctctagctttttaaacgacatcgtagctaaaactaccgataaacaaaaatgagatcttcatttaatnacaatctagtatgcctgtggtaa

SEQ ID NO: 280888 - DNA, 3386 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacaggtaacctgcgtcgccggtcggaggcaggcgcgggggagcgaggtcaggctccgtgaggtcagaagtgaggcgcttcccacgtcccgctcatggggacgcccgccacccttttcttggtctgcgaatcctgttcccaaatgggcaaggccacatcttagtactgatcggaagatattctttctcttttttaaaaacctccagtgagtcagccatatggtgctgctcctgtgcctgctgaggacgtgtgtccagtttcctatcacccttgcctcttaattagtccgcctcgctgtgtataagactgatagtaagaactttcagaagatgagatcaaatattaaacctgctaagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280889 - DNA, 3256 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataaggtatatgacaatctgttagaatgcatgagggatcatattgaataggacaatacataaacagatttggaatacaagataaatggttaatttattcaccatacttcaaaaatgaatgttctttcttgcttttggtaagataaaaagcctgtctgaattcttgattaatgctttagagaactgagaatgagtaagaacactttgatgctgtttgatttctacagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280890 - DNA, 2725 bp, Homo sapiens
tattttctgtgatgatgtatgtctatttgtattactaatacctaaaagactgtaagctttaaaacatatttttctttgttttaagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280891 - DNA, 1904 bp, Homo sapiens
tgagctcggtacccctacatttgcaggaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280892 - DNA, 1523 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactga

SEQ ID NO: 280893 - DNA, 1308 bp, Homo sapiens
  misc_feature (608)..(608): n is a, c, g, or t
  misc_feature (724)..(724): n is a, c, g, or t
  misc_feature (781)..(781): n is a, c, g, or t
  misc_feature (870)..(870): n is a, c, g, or t
  misc_feature (915)..(915): n is a, c, g, or t
  misc_feature (933)..(933): n is a, c, g, or t
  misc_feature (958)..(958): n is a, c, g, or t
  misc_feature (968)..(968): n is a, c, g, or t
  misc_feature (981)..(981): n is a, c, g, or t
  misc_feature (1013)..(1013): n is a, c, g, or t
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcagacancaagcagacatcaagcagacatcaagcagacatcaagcagacatcaagcagacatcaagcagacatcaagcagacatcaagcagacatcaagcagacatcaagcagacatcaagcngacatcaagcagacatcaagcagacatcaagcagacatcaagcagacatcaagcagncatcaagcagacatcaagcagacatcaagcagacatcaagcagacatcaagcagacatcaagcagacatcaagcagacatcaagcaganatcaagcagacatcaagcagacatcaagcagacatcaagcagacntcaagcagacatcaagcngacatcaagcagacatcaagcaganatcaagcagncatcaagcagacntcaagcagacatcaagcagacatcaagcaganatcaagcaggcatcaagcagacatcaagcagacatcaagcagacatcaagcagacatcaagcagacatcaagcagacatcaagcactgcttgatggcattgaaacgaatgggaattgtaagcgactattagagaatccgtacctttgccgtagcaatagtaggtattggtggagtaggtagtgtgactgctgaaatgctgacaagatgtggcattggtaagttgctactctttgattatgacaaggtggaactagccaatatgaatagacttttcttccaacctcatcaagcaga

SEQ ID NO: 280894 - DNA, 2111 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatag

SEQ ID NO: 280895 - DNA, 3035 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280896 - DNA, 3250 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacaggtaacctgcgtcgccggtcggaggcaggcgcgggggagcgaggtcaggctccgtgaggtcagaagtgaggcgcttcccacgtcccgctcatggggacgcccgccacccttttcttggtctgcgaatcctgttcccaaatgggcaaggccacatcttagtactgatcggaagatattctttctcttttttaaaaacctccagtgagtcagccatatggtgctgctcctgtgcctgctgaggacgtgtgtccagtttcctatcacccttgcctcttaattagtccgcctcgctgtgtataagactgatagtaagaactttcagaagatgagatcaaatattaaacctgctaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280897 - DNA, 2840 bp, Homo sapiens
ggccaggcatccctgacacctgacaagaaagtaaagccaaaagtcagctgaagataatggccatggagatgtctgtggagagccgtaaaagccaatcatggctgagatgcctgcagaatctctgcccatgagaactctgaggcctcctttcctttggctgtggtaagccctctgggaaaagagcagctacccaccaccagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatcacatctagaattcac

SEQ ID NO: 280898 - DNA, 2056 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgattgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatag

SEQ ID NO: 280899 - DNA, 1744 bp, Homo sapiens
gatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataaggtatatgacaatctgttagaatgcatgagggatcatattgaataggacaatacataaacagatttggaatacaagataaatggttaatttattcaccatacttcaaaaatgaatgttctttcttgcttttggtaagataaaaagcctgtctgaattcttgattaatgctttagagaactgagaatgagtaagaacactttgatgctgtttgatttctacagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactga

SEQ ID NO: 280900 - DNA, 2394 bp, Homo sapiens
agcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280901 - DNA, 2414 bp, Homo sapiens
agcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaagggaaacaacaacaaacaaaaaag

SEQ ID NO: 280902 - DNA, 2355 bp, Homo sapiens
  misc_feature (15)..(15): n is a, c, g, or t
ggctgtaccggcccngattttgggatgggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280903 - DNA, 3065 bp, Homo sapiens
ccccgtctctgagccaagcttttgacgagggcgggcgggcctgagcgggaagaacggtttccctggcgaccgtttccaagacgactcaaggtggagcggggacattgcacagggtgatgggcctcccagtgccccggcctgggggcggatggactcaagttctgggacgcagccatagggagtctttcgagcgagcggggaagtgtgggggaagcagctcagaagagagcaaatgtaagacccacggatatcccaggctaggcttcatatggagcgtcttaactccatgcgctgggaaggagaggacctggccactaggccggggccaggggtcctttttgtctgattctactgcccctgagcttcactagttttatgccccagttatttggttagtaaggcttttacgatcacaggcctctcccagccctttgctttcatatattgacctaaatcccaagtcttttgttaacattatggaaaggaattattccgtgttttctcaggaaaacacccagagttggaacttttatttatatcattagcggaggggcgccactggggataacgaacccagatttggttaaaggatagcgtcagggacatcatggacagggccaggactaaggccaatctggacccactttgctctcacttcttccttttccctccctgagttggacagttggattcacagactatggctgtgaattcctcaggttactcaagatggtgttgctttgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280904 - DNA, 2443 bp, Homo sapiens
agcagatcttcttccgggcggacgtggagccggaagcggaggttccgggctccgggatgaaaggagggaacgcagactatggctgtgaattcctcaggttactcaagatggtgttgctttgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280905 - DNA, 2415 bp, Homo sapiens
agcagatcttcttccgggcggacgtggagccggaagcggaggttccgggctccgggatgaaaggagggaacgcaggtgagaaagcgagacaggcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280906 - DNA, 2499 bp, Homo sapiens
agcagatcttcttccgggcggacgtggagccggaagcggaggttccgggctccgggatgaaaggagggaacgcaggtgagaaagcgagacaggcaggtagggaaatcgtgaggtgagcgtgatcctagctccttgtggcagagcctagagagaaggcgaggacgctgaagaaccaggcggacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280907 - DNA, 2340 bp, Homo sapiens
agcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280908 - DNA, 2553 bp, Homo sapiens
ccccgtctctgagccaagcttttgacgagggcgggcgggcctgagcgggaagaacggtttccctggcgaccgtttccaagacgactcaaggtggagcggggacattgcacagggtgatgggcctcccagtgccccggcctgggggcggatggactcaagttctgggacgcagccatagggagtctttcgagcgagcggggaagtgtgggggaagcagctcagaagagagcaaatacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280909 - DNA, 2409 bp, Homo sapiens
ccccgtctctgagccaagcttttgacgagggcgggcgggcctgagcgggaagaacggtttccctggcgaccgtttccaagacgactcaagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280910 - DNA, 1104 bp, Homo sapiens
  misc_feature (27)..(27): n is a, c, g, or t
  misc_feature (32)..(32): n is a, c, g, or t
tgcttttaaagccctttggaactagcnatccnctattcagaaaaaccttgcagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 280911 - DNA, 1980 bp, Homo sapiens
cgacggtggccactgcgctcctgcgtacgcgggggcagccctcgtcgccatcccctctggcgtacatgctgagcctctaccgcgacccgctgccgagggcagacatcatccgcagcctacaggcagaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagttctcctgggccagctggtgcctgtgaaggcagaggcaggaactcatccaagaggaccggccatgttgggttacagaagacatccctgcgtcagtctgcttccgcagacacagcctgagtctgttaaagttggtgacaatccacctcagtctctcaatgtgtgctattaatgaggcctctgagcttcctatccagcagtggtgaaggccttgccctgggtggcaagatacttgctctatggtcacagctcagccactggaagctgtgcgacctcaggtgagcaattcactgtccagtctccacttgtaaaaggaacgctggtgaatcctaatgcattcatattaaatgtctgttgtcaggctcagaagagccatgagcttt

SEQ ID NO: 280912 - DNA, 1163 bp, Homo sapiens
  misc_feature (493)..(493): n is a, c, g, or t
  misc_feature (539)..(540): n is a, c, g, or t
  misc_feature (594)..(594): n is a, c, g, or t
  misc_feature (603)..(603): n is a, c, g, or t
  misc_feature (651)..(651): n is a, c, g, or t
atgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcgnccgtgggccagcgcctggagagcccaggcggcgcggcgggcggcgnntacgcgcacgtcaacggctgggccaacggcgcctaccccggctcggtggcggcngcggcggcngccgcggccatgatgcaggaggcgcagctggcctacgggcagcacccnggcgcgggcggcgcgcacccgcaccgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctag

SEQ ID NO: 280913 - DNA, 1153 bp, Homo sapiens
  misc_feature (483)..(483): n is a, c, g, or t
  misc_feature (529)..(530): n is a, c, g, or t
  misc_feature (584)..(584): n is a, c, g, or t
  misc_feature (593)..(593): n is a, c, g, or t
  misc_feature (641)..(641): n is a, c, g, or t
ggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcgnccgtgggccagcgcctggagagcccaggcggcgcggcgggcggcgnntacgcgcacgtcaacggctgggccaacggcgcctaccccggctcggtggcggcngcggcggcngccgcggccatgatgcaggaggcgcagctggcctacgggcagcacccnggcgcgggcggcgcgcacccgcaccgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctag

SEQ ID NO: 280914 - DNA, 587 bp, Homo sapiens
cacccccccctccccgcccgtcaagcctttggcatcattatcctcatcactaaatcctacagagtacagggcggaaaacggtgcacaccattcacagaactggagaactccaaggggcgaaagttaaagggaaagatcccgggtcctcaatccagatagtctcttcttatacagatatctctaatgaccagatttgagatgcacatcaaattgtgtaggtatctcagtacagcttctggaacaaagttctctgccctttctcttattgttatttttttctttttaggtaccagagccagaaaaaaaaatgctgcatgggagctgcatcttagggcatgtgtattagggtgtgtgcatgatgaatttctggactggatcccaatattaaaaagtagtttggcattttaataaagggtctctaagtaaattaaaatagaacactcggttggccgatctctgaatctctctacacctcggggagacctcactacaaagtaagggagagtgtgtagggaggcaggaggagaaacgagaaaggccatagagaaacttagcagggaagggagagcatgatattaaacggcatg

SEQ ID NO: 280915 - DNA, 585 bp, Homo sapiens
ctcaataaaacttttcctgggctggatagcaaaggacacctttggttacctgaatgaacagttttggccagaaatggtgagaagaaaaagcatgaagaagccgcgaagtgtgggggagaaaaaggtggaagcgaagaaacagctcccggagcaaactgtacaaaaacctcgccaagagtgtcgggaggcaggaccgttattcctgcagagcaggagagagacgagagaccctgaaacacgcgccacctatctttgtggggagggataattgaagcgccctgagcgtaccagagccagaaaaaaaaatgctgcatgggagctgcatcttagggcatgtgtattagggtgtgtgcatgatgaatttctggactggatcccaatattaaaaagtagtttggcattttaataaagggtctctaagtaaattaaaatagaacactcggttggccgatctctgaatctctctacacctcggggagacctcactacaaagtaagggagagtgtgtagggaggcaggaggagaaacgagaaaggccatagagaaacttagcagggaagggagagcatgatattaaacggcatg

SEQ ID NO: 280916 - DNA, 629 bp, Homo sapiens
aatgagaaaattagaaaaggaggatggaggacgagcacaccaaaaagggataaaaagagagaaaaggggaggaaaaaaaacctacctgcgaagtcttgtttgtagttttggccagaaatggtgagaagaaaaagcatgaagaagccgcgaagtgtgggggagaaaaaggtggaagcgaagaaacagctcccggagcaaactgtacaaaaacctcgccaagagtgtcgggaggcaggaccgttattcctgcagagcaggagagagacgagagaccctgaaacacgcgccacctatctttgtggggagggataattgaagcgccctgagcgtaccagagccagaaaaaaaaatgctgcatgggagctgcatcttagggcatgtgtattagggtgtgtgcatgatgaatttctggactggatcccaatattaaaaagtagtttggcattttaataaagggtctctaagtaaattaaaatagaacactcggttggccgatctctgaatctctctacacctcggggagacctcactacaaagtaagggagagtgtgtagggaggcaggaggagaaacgagaaaggccatagagaaacttagcagggaagggagagcatgatattaaacggcatg

SEQ ID NO: 280917 - DNA, 1388 bp, Homo sapiens
ttaaactctttgggggaataactactctcctcccttatatagcttagaaagaaaaaatagaaaggggggaaataccctgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280918 - DNA, 3401 bp, Homo sapiens
  misc_feature (14)..(14): n is a, c, g, or t
cagctggtacggcnccggagtatggatgcaaggggaccaaggccgggactgctggggtgaaggtccgggaggctgctaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280919 - DNA, 3355 bp, Homo sapiens
ttctgcccgggaggacaaccctctgcctgaggaccagttccgaggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280920 - DNA, 2252 bp, Homo sapiens
ggggcctcggaggaggggcggcggggataaagagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280921 - DNA, 1297 bp, Homo sapiens
taaaggaacgcgccccgcgccgggcaaccacagctgcgggcgtggtctgcgcggggttgccctcctgttctggtttatcaggggatccccaaagaaagcaaggggaccaaggccgggactgctggggtgaaggtccgggaggctgctaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaatctggagatgaaacgaataaagaagaagtccaggtagggccgagcc

SEQ ID NO: 280922 - DNA, 3471 bp, Homo sapiens
taaaggaacgcgccccgcgccgggcaaccacagctgcgggcgtggtctgcgcggggttgccctcctgttctggtttatcaggggatccccaaagaaagcaaggggaccaaggccgggactgctggggtgaaggtccgggaggctgctaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280923 - DNA, 2589 bp, Homo sapiens
taaaggaacgcgccccgcgccgggcaaccacagctgcgggcgtggtctgcgcggggttgccctcctgttctggtttatcaggggatccccaaagaaagcaaggggaccaaggccgggactgctggggtgaaggtccgggaggctgctaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280924 - DNA, 2845 bp, Homo sapiens
  misc_feature (14)..(14): n is a, c, g, or t
cagctggtacggcnccggagtatggatgcaaggggaccaaggccgggactgctggggtgaaggtccgggaggctgctaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 280925 - DNA, 679 bp, Homo sapiens
tcagccttcccgacacctttcctggcttcctttccacctcactaagtgctcctccttagcctcaccctcttccatttgggttctgtcctaagtcccccctctagaccctcttactagatgatctcatccattcccaaccatagtttgatcacacccaaattcttctccagtccagactggcccatttacttaatgtgtcttcttgtagggctgggcgtggtggctcatgcctgtaatcccagcactttgagaggccgagatgggcggatcacctgcggtcagaggttcgacaccagcctggccaacatggcgaaaccccatctctactaaaagtacaaaaattatctgggcatggtggtgtgcgtctataatcccagctactcgggaggctgaggcaggagaatcgcttgaaccagggaggcggaggctgcagtaagctgaaatcgcgccactgcactccagcctgggtgacagagcaagactctgtcaaaaaaaaaaaagaagaagaagaggaagaggagcaggaggaagaggaagaggaagaaggaagaagaagaaggtgatctaaagcagaccacattggaggttgtgtggtctagaaccagtgcaggtcagaggttatacagtctggaactggagcaggttggaggttgcatagtttggaagcagaggaactggg

SEQ ID NO: 280926 - DNA, 1259 bp, Homo sapiens
ggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcgggtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcccccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcctggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaaaaaaa

SEQ ID NO: 280927 - DNA, 1570 bp, Homo sapiens
ggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcgatgaacacctgccgcgtaactgcagccacggtcaagacggaacattgccatcaacccccaaaattctaccatgccttctgtagttaagcctgcccccaaccccagctactggcaagcaaccacagatctgttctctgttgccacagttttgtcatttccagagtgtcatttatagggaaccatgcggtctgtaggctttcgagctcgtcttcctctactcagcttagacatttgagatccatccttggttgccgcaagttacaggagttcattcagttgctgaaaaaaattggtgtttggatgccccacagggtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcccccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcctggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaaaaaaa

SEQ ID NO: 280928 - DNA, 526 bp, Homo sapiens
cggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcggtgagccgcccggagcctccctccgcgcccgctccagccccagccgtcccggggcgcctctgggtttcggtcccacctctgcccccgcccagctgagctactttggacgggtcatttcggctcaccgagcctccctcatctccttcgcctccctcgtctccctggtctcctttgcccccctctgctgaatggagctgtcagcccacgcaggcagggacgggaggaatcagtaaatcgagtttgccaaaaggctgacccaggagtgctcagaaaacgtccaaggggcttggagataggtgaagcggggctgggagaccaagtggctggatttgcttttccttgcctgg

SEQ ID NO: 280929 - DNA, 1133 bp, Homo sapiens
agacagcagcgcccaccagcaggtaacacagggtgcacaggaccagcccggccgcgcgcacgctcggcctccgcatggcgccccggccccggtacccgccgcggtcccaacctgctccgtgtgcccggaccgcgcgctccaggctgagccccaccgcgccggccgccagtggaagttccccggctccttctacttcgccatcaccgtcatcactaccatcgggtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcccccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcctggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaaaaaaa

SEQ ID NO: 280930 - DNA, 399 bp, Homo sapiens
gggttgtgtgatgaaacctgggacatgcaaaaatgcacatgacttcattttcaagtaagttttatatacatatatatttaggagactcagatacggaaaattcagcccaaatatttgctagaaattaatcatgaatctgaaaaggtcattataatttggaaaaacatacagaattctattcttgctaaatgacagatcaatagatcacttttataaatagggccttgagaacccacaaaatcaaagaaaaactaaactatgttcattgtgttctggtttgagctcaaactttattatattcctgttttttgaataggcagagatctacaatttagaatagaaatttacaggcaatataattaataattttaggccgggtgcttatgtctgcaatcccag

SEQ ID NO: 280931 - DNA, 438 bp, Homo sapiens
taatcagcaggtcacattgactagacgaaaaatggttgagccagatggccttctatactgggagagattcttggttatgcagcacaagaatcacagatatggctgatcctatcacaaatgtgccttgccagacataaagagatactttttcccttcagaagagtgaacaaggaccaagacagatggtttaaagtaaaagaaaaagaaacagtatgaaacctcagctggggatcacttgaaaccatacaaggccaccaaggataggttcccaccttggaccacacaagatcgccaacctgaaacttaacaccagtggacacttccgttgttggaacagaagatagtattggctgaacctacaggaaagggtcaaaaaacttcatcagaaattcaaaaaaagaaactatgtataaagtacattaaaaatgctaacaatgt

SEQ ID NO: 280932 - DNA, 747 bp, Homo sapiens
taatcagcaggtcacattgactagacgaaaaatggttgagccagatggccttctatactgggagagattcttggttatgcagcacaagaatcacagatatggctgatcctatcacaaatgtgccttgccagacataaagagatactttttcccttcagaagagtgaacaaggaccaagacagatggtttaaagtaaaagaaaaagaaacagtatgaaacctcagctggggatcacttgaaaccatacaaggccaccaaggataggttcccaccttggaccacacaagatcgccaacctgaaacttaacaccagtggacacttccgttgttggaacagaagatagtattggctgaacctacaggaaagggtcaaaaaacttcatcagaaattcaaaaaaagaaactatgtataaagtacattaaaaatgctaacaatgtaattttatcttcagttatactttgatacaggaaagtgtcaaaaaacatcagaaattcaaaaaaagaaactaggtataaagtacattaaaaatgctaacaatgtaattttatcttcaattatactttgatacaggaaagggtcaaaaaacatcagaaattcaaaaaaagaaactagatataaagtacattaaaaatgctaacaatgtaattttatcttcaattatactttgatacaggaaagggtcaaaaaacatcagaaattcaaaaaaagaaactatgtataaagtacattaaaagtgctaacaatgt

SEQ ID NO: 280933 - DNA, 644 bp, Homo sapiens
taatcagcaggtcacattgactagacgaaaaatggttgagccagatggccttctatactgggagagattcttggttatgcagcacaagaatcacagatatggctgatcctatcacaaatgtgccttgccagacataaagagatactttttcccttcagaagagtgaacaaggaccaagacagatggtttaaagtaaaagaaaaagaaacagtatgaaacctcagctggggatcacttgaaaccatacaaggccaccaaggataggttcccaccttggaccacacaagatcgccaacctgaaacttaacaccagtggacacttccgttgttggaacagaagatagtattggctgaacctacaggaaagggtcaaaaaacttcatcagaaattcaaaaaaagaaactatgtataaagtacattaaaaatgctaacaatgtaattttatcttcagttatactttgatacaggaaagtgtcaaaaaacatcagaaattcaaaaaaagaaactaggtataaagtacattaaaaatgctaacaatgtaattttatcttcaattatactttgatacaggaaagggtcaaaaaacatcagaaattcaaaaaaagaaactagatataaagtacattaaaaatgctaacaatgt

SEQ ID NO: 280934 - DNA, 533 bp, Homo sapiens
taatcagcaggtcacattgactagacgaaaaatggttgagccagatggccttctatactgggagagattcttggttatgcagcacaagaatcacagatatggctgatcctatcacaaatgtgccttgccagacataaagagatactttttcccttcagaagagtgaacaaggaccaagacagatggtttaaagtaaaagaaaaagaaacagtatgaaacctcagctggggatcacttgaaaccatacaaggccaccaaggataggttcccaccttggaccacacaagatcgccaacctgaaacttaacaccagtggacacttccgttgttggaacagaagatagtattggctgaacctacaggaaagggtcaaaaaacttcatcagaaattcaaaaaaagaaactatgtataaagtacattaaaaatgctaacaatgtaattttatcttcagttatactttgatacaggaaagtgtcaaaaaacatcagaaattcaaaaaaagaaactaggtataaagtacattaaaaatgct

SEQ ID NO: 280935 - DNA, 685 bp, Homo sapiens
ttttttgttgagacggattgcacgtgtcgcccagactggagtccatctaaaaaaaaaaaaaagtttggtttagggtaataataggtcaattacagaaaagaggaaaaattcacgagacatagcaaaaaagaaactacccaagacttgagagcaaataatctaattagtcccacatcacaacttgggttgtgaggagtttgttacctcaaatggcactggatttggcaccatgttttccccaaattgtattgcttggttttttccttttctggctgacgaaatgacaagcagggtcagtggtccaagttctctgtgggtttttttttttttttcatgttatttaattttttgagacggagtctcactctgtcgcccaggatggaatgcagtggggttaagcgattctcctgcctcagcctcccgaatagctgggactacagggcatgtgccaccatgcctggctatatttttttttttgtatttttaatagagacggggtttcgccatattggccaggctggtctcaaactcctgacctcaagtggtctgcctgccttgccctcccaaagtgctgggattacaggtgtgagccaccgtgcccagctgtttttatataagcatccagggaaaagtcagccagcacactcaggaagtcattgtcactcagggctttgtgagtcacccc

SEQ ID NO: 280936 - DNA, 344 bp, Homo sapiens
caatcatgggaaatatccagccaattctggttttaaagattcatatcaaattcaaagtccctccctccttttggcgaggaagacaaccctttggagcgaaacacaaaagagcaaatgtaaaatccatctggggcggggcatggtggctcacgcctgtaatcccagcactttgggaggccaaggcaggcagatcacgaggtcaagagatcgagaccatcctggccaacatggtgaaaccccgtctctactaaaaatacaaaaattagcttggcgtggtggcacatgcctgtaatcccagctactcgggaggctgaggactacagatgcacgccaccacactcagc

SEQ ID NO: 280937 - DNA, 2116 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280938 - DNA, 710 bp, Homo sapiens
ctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagaatccccccaagccacccatggagggcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaaggtaaacaaaggcatcgcccctgccctccctccctccaacggcccaactgcagcctcccactcggttcgggccgcgtcacgcaattagccacagtgcccctcacctgctctgctgccccgccctccacgaccacctcttcgaaggaatcccccttcccccagcaaaggacccgtccgcggcgtgaaggctgctgggaagtgtggtccaagcgcggattagggcctgctcggagtcccaggagcccctcttgcagctgccggatcggcctgaaccttaaaaacccaggacttataatggttgcggggacgtttccacttggttctgtaatttgccctcaccc

SEQ ID NO: 280939 - DNA, 1992 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280940 - DNA, 1987 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280941 - DNA, 2014 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280942 - DNA, 1164 bp, Homo sapiens
ggaccgttaatgatctgtgggcatacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280943 - DNA, 316 bp, Homo sapiens
aggacggggaaccggtatacgtgaatggggaggtggaggcacagaagcctagggcagaccaagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280944 - DNA, 384 bp, Homo sapiens
ccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttctttttt

SEQ ID NO: 280945 - DNA, 312 bp, Homo sapiens
gtctagagaatcccttactctgttccttacctttcaggagaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacagg

SEQ ID NO: 280946 - DNA, 576 bp, Homo sapiens
  misc_feature (570)..(571): n is a, c, g, or t
  misc_feature (573)..(573): n is a, c, g, or t
  misc_feature (575)..(575): n is a, c, g, or t
tgttttatatgaaatattccaaaaggaatgtttcataagttaaccttccagaattctaatttcagattttctgagtgataacctttcttttctacccataagaaaaaaaaaaacttcataggtagcatagtgtagtgtttcccaacacttgatttcttttagtgacacatataaattcttacgtttctgtgaaattgtaccttgtaccatgaaatgggtaccaatcgagaggctttgtattcaaaagctcagtccttgaaattaatacggcttactggtaatgaagaaaatctgaaggaaaaacaggatgcatggacaagaataactccttttactgattctttatatttgattgcaggtcacctggattcttcaggacttcaggaagtgcatttagctgggatgaatcatgaccagcacctaatgaaatgtagcccagtgagtagcctctctttttttgggttttgttttgcttttcaggtgggaggcagagggtttccattgcacctgtggcttgaggatgctggacgttctcagcaaataaagaaaatgtgagtgtttaatggaaannanana

SEQ ID NO: 280947 - DNA, 1897 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280948 - DNA, 2026 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280949 - DNA, 2253 bp, Homo sapiens
ctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagaatccccccaagccacccatggagggcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280950 - DNA, 2017 bp, Homo sapiens
tgttttatatgaaatattccaaaaggaatgtttcataagttaaccttccagaattctaatttcagattttctgagtgataacctttcttttctacccataagaaaaaaaaaaacttcataggtagcatagtgtagtgtttcccaacacttgatttcttttagtgacacatataaattcttacgtttctgtgaaattgtaccttgtaccatgaaatgggtaccaatcgagaggctttgtattcaaaagctcagtccttgaaattaatacggcttactggtaatgaagaaaatctgaaggaaaaacaggatgcatggacaagaataactccttttactgattctttatatttgattgcaggtcacctggattcttcaggacttcaggaagtgcatttagctgggatgaatcatgaccagcacctaatgaaatgtagcccagtgagtagcctctctttttttgggttttgttttgcttttcaggtgggaggcagagggtttccattgcacctgtggcttgaggatgctggacgttctcagcaaagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280951 - DNA, 2280 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtaagcagatttctggagatggtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggtaaagggtggggcatgcggggagccaaactttaacaactcaactcccagggcctgcaaagccttcagagaagaaactgctgctcctccttagccactgccagcagcagcatctctattatccttcataggtagagttcaggagaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 280952 - DNA, 2367 bp, Homo sapiens
ggaggtcacaagctctggtgccccaaaatggctctggtcctcagatatagttggttgccaccctgggagtgagaggaaccaggaaagcagcacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 280953 - DNA, 2592 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 280954 - DNA, 2321 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaagttttgtacatcaggaagaagaagagggaaaccttaaggccctaagcatggttgtgtgctgtggctcagctagtcaggaggcagggcctggagggctgctgggaggggaagggcctgccctgtccccagcagcctttgcccccatccccaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 280955 - DNA, 2022 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaaactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 280956 - DNA, 1343 bp, Homo sapiens
  misc_feature (30)..(30): n is a, c, g, or t
ccttccgacatctcatttgttccacattangggcagaccctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 280957 - DNA, 1805 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgctgttcttttatacctgtcttattgtcttattcatgagcatttctgttcacatgattattcatgtgctttgttctgtactttattcctatttttattgtttactttttttcattctttcatgttgtctttttattcttatct

SEQ ID NO: 280958 - DNA, 2196 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaagttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 280959 - DNA, 2731 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgtttaaaaaaaaaaaaggggggtctaaaaattccgggccgattactggcattttgaaggccaaaggggtaaaaagaagggggaaaaggaggaactcggtttggagactctggtgatgaccacgaaggggaatgtgactcgttga

SEQ ID NO: 280960 - DNA, 2596 bp, Homo sapiens
gggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagctggtgtgcagtggcgcgatcttggctcactgcaaccccgagctgg

SEQ ID NO: 280961 - DNA, 467 bp, Homo sapiens
tggtcccactcttttgttcagcaagctttagtcaacttatttgtaaccctgagttgtctattcatatttaatgagggaataggcctagaagctctgtgggtgaacagggagctagaattttggagaatttgttcagagaacattcccgtggatttttgtttcctctaaatgtgtttctggctaggattgctggaactttgctattttccataggtgctactattaacttccctcttttcagttccacttcccactctagctttcaataataccattatttctgaagccagaacctctcccagggaatattgacttctttatcagctccagctccctgccatagtttttaatagtacgtttaaaccattctccaaaaaaggcagtaacccgtagtgaataatggggcttaacagtatagtcagttaagagagaaaaataaccttttaggggttggggttgctttttaa

SEQ ID NO: 280962 - DNA, 944 bp, Homo sapiens
cggccgcgaactggcccccatcaccgccgacctgccccggccgccatgttgggaggaaacgacgcgtcacgcagcggccgaacggctgcagacgaggaagcggcggcggcggcggcggcggcggcgctccctgcccagagctgccgcggcgccgggaggctgggggcggagggcggcgcgggaggagcggcccgagccgcagcgctacggcggcccggcggggcctccagcgttcgcctgcagggcggcgtggggcgtggcgggcctctggtggcaccgcgcccagcacttcgggctcttggtggcggccgagctgcgggaccagagatccccccactcggcacccctgctcctgccgagtgaacaggactcctggctactctgcactggctttctaactttctgatgggggtgcagtcctttgcattccaggggtcacagcaacacccgcatcgcccgttctcagccgcagggtctccgcctgcatcactcgactctaaaatttccttccctagtgcacggaactgctgtccaggactctgctctccgactacctcagggaggattctgttttgggaaaaatgctatgttatgcattggggatcaaatatgaagaagccacagaccctgagttgaggaacataaagattatgctggaagacataaagcacctcaaatccactgctcacaactggactcatgtttttcaccggattctgacctcctactagctgccaaatcttggtaagcagcaaagaagaaagtaagttgtctggcattggtaagttccggagaatcaagtgcagaaatcactgcagaggacctaaaaataaccacacatccaatgcaggacacactggcagaacgaagcctgttacagctaaggccaaagaaaggggcacagtcaccatcaagctgaagaccagcctcaactggacgggaca

SEQ ID NO: 280963 - DNA, 507 bp, Homo sapiens
  misc_feature (497)..(500): n is a, c, g, or t
  misc_feature (502)..(506): n is a, c, g, or t
cgtgggcaccgggcgcttgtcctggaagaagcgcttgagcgtgcagacctgcagcacagccaccagcagcagcaccgccacgttgacagctgaccagaagttgacccgctccaagttgccctcttgcaggttgcggtcacgtgcctcgaaggcccgcagtagcgtgagcatctggatgctgcgctccagccgggtccgcatggtctcaatggactcctacagggcagcgggaggggaagggtcaggcctccctccacccatcagggagcagagaccaaaaaaaccgggggatacggagggaggctgtattaaccctgggaggtacagctgcaaacacagacttgttcaggctaagttcaaatcctcaccctgccactcactggctgtgaccatgagcaacttaattaacctatctgagcctgtttcctcttctataagcttccaaattgctgtgaacatttaatgcctaaataaatgtacaaggatgagcatggtgnnnnannnnna

SEQ ID NO: 280964 - DNA, 909 bp, Homo sapiens
gagattgcgaaactggacaaactgctgaacctggacaggggccagggctggagttgggactggattcagagagagagtcaacgtcggcagagcgagaatggcaggcccagcagaggatgacccagagcagcagcagcaagaagcccacgagaccgttgcagacgatggcgatgagggccccctgggagatggctgcccccatgacaggcagcaccctcagaccagcacagacagtggagctgcctcaatggactccagccagcccgaccaggagacctccagaggcgccagcttgcacagagggaactttgtggaggccctggcaggcatgtgcaggctctgtgcgtccagggctgtgtgcctctatgtggggctgcctctctgggtcaggccagtgattgtcacctattctgatccggccgtcttctcatcccgctctacatgctctccttggaggatcacatccctgaagctatatcatgaagactcccagtgctcccaagtctagccttaacttctctctggaatcctagactcatataactaagtgcctactgtaatcggggcagtattgattcctggttcacttactaactttgtgatcttgagcaagttactaaatctctcttagcctcagcttcctcatctgtaaaatggttgtaatgctacctctcagggttgttattcactaatttatagcagatcgatcacatctcagcaaatgccagctgacacaacccccaggaccatgtgactaagaggccccttcccccaatccaatgccatgaaattcacataagacccctgtaaatccagatgctatcttgaaagaagaaagggaagactgagtcatccaaagctaccaaagtacttagagactgtctaaaataaattattggatcctataga

SEQ ID NO: 280965 - DNA, 2286 bp, Homo sapiens
  misc_feature (1227)..(1227): n is a, c, g, or t
  misc_feature (1235)..(1235): n is a, c, g, or t
  misc_feature (1244)..(1244): n is a, c, g, or t
  misc_feature (1253)..(1253): n is a, c, g, or t
  misc_feature (1260)..(1260): n is a, c, g, or t
  misc_feature (1265)..(1265): n is a, c, g, or t
  misc_feature (1268)..(1268): n is a, c, g, or t
  misc_feature (1275)..(1275): n is a, c, g, or t
  misc_feature (1286)..(1286): n is a, c, g, or t
  misc_feature (1298)..(1299): n is a, c, g, or t
  misc_feature (1305)..(1306): n is a, c, g, or t
  misc_feature (1325)..(1325): n is a, c, g, or t
  misc_feature (1329)..(1329): n is a, c, g, or t
  misc_feature (1334)..(1334): n is a, c, g, or t
  misc_feature (1340)..(1340): n is a, c, g, or t
gaggtcactctctctatctatgtcgcctcaagcagcagtggcacgcaaaggtcagtcagccctggccaggctgcgccctccccccggacagcactcaccgttggtgtagggagaccccgaggccaaggcggctccgttctgggcctggaggctggctggggcgccgccggaggccggtattcccggctgggacatgatgactgggttggaaggggctggtcggggtcgacaacagcgcacaagaagagagctgaaagaccactgctgaaagcggagggaggaggctaacgacttaagactgaagactgggagaagaggggggggcgcattaagcccgaggcatggcgccgcactctccccaggccaccggcggccacagcctagcctgggagctgaggcttgagagtcgggccggcggggccgcgaacgcccggctagaaggcggcagccaaacctagagagaaggagggaggccctggccggaagtgcctgtcagccgccggccgcgcagccgcaatcaggacacgtggcacttccggctccgggctcgcagcagccgccgccgcgccggcgaactcttctctgccagccgggctgccccgaggccacctgacagctcctggtgccccgaccccgacgaccgtgcccggcctcgccgccacgtcaccgactctcacggccggccggaagtgccgtgtgtcaccgctacggaaattcccgccgttgtgaacgtgacctcgctcgcagagccaggatcgtggggcaatctgagattcagtagccgctttcgtggggtgggactgacagttcctctcctcgggttttgtgaagattacctgagaccatagaagtcatcgtcctctgttgagaccgtaccaccactgggagctggggcggttaatgttcatcgcagtatttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggaaaaacaacattgctacacatgctaaaagatgacagacttggacaacatgtcccaacattacatcccaanggagtctngctctgtcncccaggctngagtgcngtggngcnatctcgnctcactgcaanctccgcctcccnngttcannccattctcctgcctcagcntccngagtngctggnactacagcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggc

SEQ ID NO: 280966 - DNA, 881 bp, Homo sapiens
acccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttg

SEQ ID NO: 280967 - DNA, 1000 bp, Homo sapiens
acccgccggcccggaaggggctgatgcgaactggggccacggcagccatcgcgctttgcagttcggtctcctggtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttg

SEQ ID NO: 280968 - DNA, 735 bp, Homo sapiens
acccgccggcccggaaggggctgatgcgaactggggccacggcagccatcgcgctttgcagttcggtctcctggtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacaggtgcccgccaccacgcaccgctaatttttttgtattttttagtagagatggggtttcaccgtgttagccaggatggtctcttatctcctgacctcgtgatccgcctgcctcggcctcccaaagtgctgggattataggcgtgagccaccgcatccggtctaacttttctatttttagtagagatgggatttctctatgttggccagtctggtctccaactcctgacctcaggtgatctgctcgcctcggcctcccaaagtgctgggattaaaggcatgagccacctcagtgggccactgtactgatttttaaggtgttgaagcttttccaagaagatttgttttaaaacagctaaaactttgacattgttagctgaaagaaccaaattcgtcagcaatttaaggtgtttggtacagtggacaaaatgaggtgaagaagtccttttaacttgaaaaattaaacatagtattatttatttgtgtgttcttacatcagc

SEQ ID NO: 280969 - DNA, 282 bp, Homo sapiens
cggacgcgtgggtcgacccacgcgtccggagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggc

SEQ ID NO: 280970 - DNA, 1874 bp, Homo sapiens
acccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggttgttacgcgtgttcccccccgctgtgtgtattaccctggagataagtgttcactagtcggt

SEQ ID NO: 280971 - DNA, 1374 bp, Homo sapiens
acccgccggcccggaaggggctgatgcgaactggggccacggcagccatcgcgctttgcagttcggtctcctggtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggc

SEQ ID NO: 280972 - DNA, 1586 bp, Homo sapiens
aatcccactatcagcaatacagtgagcatcgctggccctgatatgtacaatgaacatgatccgtatcgtgcatgcttaagacatccatgatctgtgacatagatgctactgtatctgcatcctcaattggaaatcgctatggcgtgcgtggcagtatgctgctacagacacagaatcgcgacgtatgtgaagatgtctagagagtacaagtatacttggaatcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280973 - DNA, 1795 bp, Homo sapiens
acccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctccaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280974 - DNA, 1371 bp, Homo sapiens
aaaatgaacacattgctttgcgtgacttattcagattgttgctaactacaatgagaggatgcctaaagctatcgatataccgtagcttgcaaagcactttgcctggtatattgcctgcacgggacactacacatatatatactgttgagatcctctaaagctccggaaccgttagcattcaacactgtgtactgtgctccgaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280975 - DNA, 1216 bp, Homo sapiens
gaaccgagctgatacccctagtttagaagtttcaatagcagtggccaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280976 - DNA, 1220 bp, Homo sapiens
cgtaatgattgagcctacagatgataggatgtttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280977 - DNA, 770 bp, Homo sapiens
tgagaagagaaacacttctggaacttggttttgggaataaccattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280978 - DNA, 1689 bp, Homo sapiens
  misc_feature (175)..(175): n is a, c, g, or t
  misc_feature (225)..(225): n is a, c, g, or t
  misc_feature (234)..(234): n is a, c, g, or t
tggtccaatatacaggtgtgtggtattatgcacgagacaatggtttgtttgggaggccgtggatggataggtgtctggcaatgcaaagtgttgcagtggcttcaggaagaaagctactagaaggcattggttatagctgggttctgagaagcaggtaatggcattcggggagcangaccactatgaagcgaaggtgtcactgattagaggccacaggtggtctantaagagtcngcccagatccctgagaaccaccatagttagactgtccagagactggattcaaagtctttgctggtattggatgagggtaggatcctggaagctggaaattgtatccttggctcactgactcttgtgaagacacaatgcattttgacagaccgttggtgtagggagaccccgaggccaaggcggctccgttctgggcctggaggctggctggggcgccgccggaggccggtattcccggctgggacatgatgactgggttggaaggggctggtcggggtcgacaacagcgcacaagaagagagctgaaagaccactgctgaaagcggagggaggaggctaacgacttaagactgaagactgggagaagaggggggggcgcattaagcccgaggcatggcgccgcactctccccaggccaccggcggccacagcctagcctgggagctgaggcttgagagtcgggccggcggggccgcgaacgcccggctagaaggcggcagccaaacctagagagaaggagggaggccctggccggaagtgcctgtcagccgccggccgcgcagccgcaatcaggacacgtggcacttccggctccgggctcgcagcagccgccgccgcgccggcgaactcttctctgccagccgggctgccccgaggccacctgacagctcctggtgccccgaccccgacgaccgtgcccggcctcgccgccacgtcaccgactctcacggccggccggaagtgccgtgtgtcaccgctacggaaattcccgccgttgtgaacgtgacctcgctcgcagagccaggatcgtggggcaatctgagattcagtagccgctttcgtggggtgggactgacagttcctctcctcgggttttgtgaagattacctgagaccatagaagtcatcgtcctctgttgagaccgtaccaccactgggagctggggcggttaatgttcatcgcagtatttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggtaaagaactcaaacttcctttcagagcaagtagactttttttttttttgcaagttgacttttttgacttttgaagccaaagggaggtcgaaactgcggtgattggacaacatagttaattaatgattgagtaatcatcttagctgccttcattctatttaggtttttcctgctctgtgctgacgataaagccctcctttacagatttgtactgtggattaaaatgtcatgccacgcggtttcgaaa

SEQ ID NO: 280979 - DNA, 256 bp, Homo sapiens
aaagaacgttggtatgacatgatatggtagaaaatgaggcctttattgttttatcatatcaaaataagctctttggatggtttcatatcaactcttgttttgtattgttttgtttttttcagtcactaatgacagatgaaaccattgctaatgtgcctatactgattcttgggaataagatcgacagacctgaagccatcagtgaagagaggttgcgagagatgtttggtttatatggtcagacaacaggaaaggt

SEQ ID NO: 280980 - DNA, 1255 bp, Homo sapiens
acccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggc

SEQ ID NO: 280981 - DNA, 1851 bp, Homo sapiens
acccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280982 - DNA, 2450 bp, Homo sapiens
  misc_feature (175)..(175): n is a, c, g, or t
  misc_feature (225)..(225): n is a, c, g, or t
  misc_feature (234)..(234): n is a, c, g, or t
tggtccaatatacaggtgtgtggtattatgcacgagacaatggtttgtttgggaggccgtggatggataggtgtctggcaatgcaaagtgttgcagtggcttcaggaagaaagctactagaaggcattggttatagctgggttctgagaagcaggtaatggcattcggggagcangaccactatgaagcgaaggtgtcactgattagaggccacaggtggtctantaagagtcngcccagatccctgagaaccaccatagttagactgtccagagactggattcaaagtctttgctggtattggatgagggtaggatcctggaagctggaaattgtatccttggctcactgactcttgtgaagacacaatgcattttgacagaccgttggtgtagggagaccccgaggccaaggcggctccgttctgggcctggaggctggctggggcgccgccggaggccggtattcccggctgggacatgatgactgggttggaaggggctggtcggggtcgacaacagcgcacaagaagagagctgaaagaccactgctgaaagcggagggaggaggctaacgacttaagactgaagactgggagaagaggggggggcgcattaagcccgaggcatggcgccgcactctccccaggccaccggcggccacagcctagcctgggagctgaggcttgagagtcgggccggcggggccgcgaacgcccggctagaaggcggcagccaaacctagagagaaggagggaggccctggccggaagtgcctgtcagccgccggccgcgcagccgcaatcaggacacgtggcacttccggctccgggctcgcagcagccgccgccgcgccggcgaactcttctctgccagccgggctgccccgaggccacctgacagctcctggtgccccgaccccgacgaccgtgcccggcctcgccgccacgtcaccgactctcacggccggccggaagtgccgtgtgtcaccgctacggaaattcccgccgttgtgaacgtgacctcgctcgcagagccaggatcgtggggcaatctgagattcagtagccgctttcgtggggtgggactgacagttcctctcctcgggttttgtgaagattacctgagaccatagaagtcatcgtcctctgttgagaccgtaccaccactgggagctggggcggttaatgttcatcgcagtatttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggc

SEQ ID NO: 280983 - DNA, 1931 bp, Homo sapiens
acccgccggcccggaaggggctgatgcgaactggggccacggcagccatcgcgctttgcagttcggtctcctggtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgatctgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgaaaaaaaaaa

SEQ ID NO: 280984 - DNA, 6652 bp, Homo sapiens
ctttcaaataaggtgttgatttatgtggtcttgagaaatctttgttgctctgatcttaagtttctttttataatattagaatcatagtttacctacattacagggcttttatgaagattaaatcgagcatcgtgggtagtgttttttcagcccctgtgactaagtaggttataaatggtcctcagtcatcatcatcataaatgattcaaggcctgaatggcagaagaagaagaggaaaactcaagtgaaaagtgctagacatagaacacagcttacctaataaaacatgctactggctaactaagctggggtggctttctgccccctctacttaaatttaagaaagaaaaacagaaacgtctctgcatctgccactgcataccctctcagagcacagaccaactttgcccttccttaaaagtcccagggtttacctaccaacttttaggaaataaataaccagcctcaaagcttggcaaagagggcatcagtatcagctctagaggtttgctccgatttatatctcctcctccagtaaagtcttctgctcccactcccagccaaccccgctcaacgcccacccctcactgcggcactggacgcgcgggggatgcggggttgttcccagagtagccgctaaggggagccggacgctagaccgccctcccgcgttcccatgacaacgacaccggcgggcgcgtagcctggagagcgaagtgccggctacagcaggtgtcggattgcagtgcgctcgctgaggctccggaccttggagcgtctagagtctggctactgttcctccgcctccctctcgggcagctccctaagccggctgggacgcgcagagtgaaaatggtccaccattcaggctccattcagtcctttaaacagcaaaaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaggagaattgattacatcttggtttatagaaagacaaatataccatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaagactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctgtactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatgggccacagtcttcctggagttttggaaaaggagaaggagtatactgacctatacttgggaccttatcgaatgggaagaagaggaggaaacacttcgtccccagtttgaagccaagtattacaagatggagattgtaaatcccatcacgggaaaacctgaaccacatcagccttcctcagacaaagtcactcgtcttcttgtttctgtctcaggaatattcttcatgatatccttggtgatcactgcagtgtttggagttgtggtgtaccgcctggttgtcatggaacagtttgcatcattcaagtggaatttcatcaaacaatactggcagtttgcaacatctgctgctgctgtctgtatcaatttcataatcattatgttgctgaatcttgcttatgaaaaaattgcttacctcctcaccaatttagaatatcctcgaacagaatcagagtgggaaaacagcttcgccctgaagatgttcctcttccagtttgtcaatttaaacagttccatcttctatatcgctttctttttgggaagatttgtaggccacccaggaaaatacaataaactttttgaccggtggagactggaggaatgtcatcctagtggctgtttgatagacctctgcctccagatgggtgtcatcatgtttttgaagcaaatatggaacaacttcatggaactaggatacccgttgatccagaactggtggtcacgacataaaatcaagcggggaatacatgatgcttccatacctcagtgggaaaatgattggaatctgcagcccatgaaccttcatggactgatggatgagtacttagaaatggttttgcaatttggttttaccaccatctttgttgcggcttttcctctagcccctcttttggctttgttaaacaatatcattgaaatcaggctggatgcatacaaatttgtcactcaatggcggaggcctttgccagcccgagcaactgacataggtatctggcttggaattctcgaaggaatcggtatattggctgtgatcaccaatgcatttgtaattgctattacttctgattacatcccacgttttgtttatgaatacaaatatggcccctgtgcaaatcatgtagaaccaagtgaaaattgcttgaagggatatgtcaacaatagcctatccttctttgacctgagtgagcttggtatgggaaaatctggttattgcaggtacagagactacagaggcccgccttggagttccaaaccctatgagtttactttacaatactggcatatccttgctgctagattggccttcattattgtgtttgagcaccttgtttttgggattaagtcattcatcgcatacctgattccagacgtaccaaagggtctacatgaccgaatacgacgagagaagtacttagttcaagaaatgatgtatgaggctgaactggaacatttgcaacaacaacggagaaaaagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagacttgtagggaagaaaacaatgacttgacgaccttaaaaagggttagattgacattgcaggaagccaggatgtaattctcagaaccagtctcagggagatatatgcttggagaactctgccttccatcaactgcagtgtaatgggaaagagggtggtgaggttttgaaagacagatttccatgtaaatgtgcacaagccaggcatggcttaaaatatcatgcagtcttcactcacatactaatttgactttggaaagtatggttgagttcagatacttataagaaatgacttaaacaaatccttgccttggctgccagaactctacatcccttcagtttacaggttggtaggaattgcccatgtctcttgctgagattatggatctgtgccacaggggatttatgctgctttacattgactatgcagttgaagagttgcacatcacctttagtggtcaaaccaaaaatctaagattccaaaaagaacagcattcattgaaataatattccattgcattggctacttcaagtctcttttacccctggcagagccagttgcagtgcaattttttgtactaaatgccaataaagccacatacttataaactatgaatggctattcttatatagtttagaacacaactaatccatactttattgtggaaggctgttttatagtatatttaattttttctctatgatttattacaactctcacggaatattaacttgaaatgctgtaaatacgttggttttccttgtccctttgcaccttgacagtacgtagtatacattgtggtttatgcagctctgacaccagtttttgctattgtaatatgtttattcgggaaaactgaggccagatgctctgcaacacttacgctttttcaacaatgtgcactcttactcatgaactaatgaaaataatgcatgaatataaatctatattatttgctaaaaaaagaaaaaacatttgtgttttagtttcttttttcatgactgaagggagttttatgttattatttcttccatagttttgttttggtttatttttaacaacgctctagaaacaaagtcaaattaatcacaaaagacataattttgctttgttgtggaatttctatttcaacgtcaactctgtatctatgagtatgtctgttccacagacagatgaggcaggagtgatggggcactcaagaaagttcagaggaggcataagctatggaggttggaaaggaagaaagagaagagctgaagtaaatgtatggtagaaattaagacgtttctttgcaaaacaaggaaatcacacatatgcacacatacatatttatggttactatgattgttattatttgtccaatcaagcaaagcaccattatttctaacatataaaagaccagatcaaacacaatggaaataaagctactacatatatatgccagtatttctctagtaagattatgtttctcttactagaaaactattttctaaatattaacactgaaaatgttttgttagcttttccttctttctctccagaagaaacatggatagatgatagctgtttcattgtttgtttttgtcaagcatattcactttcctccttgtcctctgattctgagcaaagggcctcagactctgaacttccctcaagtgccgttgttatgtgaactcttccattcagattccagagaggttctcatgctccccccccctccttatttgtagcaatcgtagcaactaattccactaagtacaagggagttttttacactcctccatttttatagcatctgcatttttttttctttgttaggtacatgtatacacctgcctgagtataaatactctctctacctaataataacatcaaccaacatcttttccaaattagggccacagaacagcaacatttgtctgacagtagtataaagaataatgatagctctatccttaagaagtatttcctttcctttttatatagtcccgttagggtttaaaaccatattgatcaactagaaagaaaaatatgaaaagagaaaaatattttaatttaaaaattgtaatacattgatttataaaatgccttctctgatacttttgaaacagatgtgaaaaacagaaaaagaaaaaattgtctgaaatgtttattttgcaaaacagtgcaatagaatctagttatgccttcatcactgttgacagtaaatactgacagccccttgcagtgtgttagttttagatcactctgttttagttgagagaaatgttttatatcatggtttttatatgaatacaaattatttctcaaagatttatagcacacactattctcaggaattctgtattacatgaatgctgcttatatattttcatattctaacttgtcttttcaagcaaataactaatatatatgtgcatgcagtctgccttgacaagttgttccaagctgaagagctttcactgtacaatgtgtggaaaatcaccatagatcatggctgaaatagtttgtaattgtctgagtctgtgcacgtacttttagataaaatgctgctgagtgactgcatgatgagatacaacttctgaatgctgcacattcttccaaaatgatccttagcacaatctattgtatgatggaatgaatagaaaactttttcactcaataaattattatttgatatggtaaaaaaaaaa

SEQ ID NO: 280985 - DNA, 2710 bp, Homo sapiens
ctttcaaataaggtgttgatttatgtggtcttgagaaatctttgttgctctgatcttaagtttctttttataatattagaatcatagtttacctacattacagggcttttatgaagattaaatcgagcatcgtgggtagtgttttttcagcccctgtgactaagtaggttataaatggtcctcagtcatcatcatcataaatgattcaaggcctgaatggcagaagaagaagaggaaaactcaagtgaaaagtgctagacatagaacacagcttacctaataaaacatgctactggctaactaagctggggtggctttctgccccctctacttaaatttaagaaagaaaaacagaaacgtctctgcatctgccactgcataccctctcagagcacagaccaactttgcccttccttaaaagtcccagggtttacctaccaacttttaggaaataaataaccagcctcaaagcttggcaaagagggcatcagtatcagctctagaggtttgctccgatttatatctcctcctccagtaaagtcttctgctcccactcccagccaaccccgctcaacgcccacccctcactgcggcactggacgcgcgggggatgcggggttgttcccagagtagccgctaaggggagccggacgctagaccgccctcccgcgttcccatgacaacgacaccggcgggcgcgtagcctggagagcgaagtgccggctacagcaggtgtcggattgcagtgcgctcgctgaggctccggaccttggagcgtctagagtctggctactgttcctccgcctccctctcgggcagctccctaagccggctgggacgcgcagagtgaaaatggtccaccattcaggctccattcagtcctttaaacagcaaaaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaggagaattgattacatcttggtttatagaaagacaaatataccatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaagactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctgtactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatggggtaagtactttcttcattactttctatcccttattttctgaagctgtttctgtgttacacacacacacacacacacacacacacacacacacacacaccatgaatcaattcaaaaataaagcctctaggttggtacttgatttgtttgctctcttcatatattcagtgcttctttaggaatttaactcttgatctcatcctctaatctctaaaacctagactttcctacatcaaggaacatattttttctaccaaaggaaggtggtaattaaaaacaaactgaaacatactagaatccaaattaatcttcttatattattgattatgaaactgatgctcagtaaaaagttgtttgatatttccattcatcttttttaaccttatggttcatacatttagggatgcagaatc

SEQ ID NO: 280986 - DNA, 431 bp, Homo sapiens
caacattgttcattgttgtactgttttataattagcatttcagaatctttgaaaactgtccttttcacatttaaatttgcagcaccttgtttttgggattaagtcattcatcgcatacctgattccagacgtaccaaagggtctacatgaccgaatacgacgagagaagtacttagttcaagaaatgatgtatgaggctgaactggaacatttgcaacaacaacggagaaaaagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagact

SEQ ID NO: 280987 - DNA, 2500 bp, Homo sapiens
ctttcaaataaggtgttgatttatgtggtcttgagaaatctttgttgctctgatcttaagtttctttttataatattagaatcatagtttacctacattacagggcttttatgaagattaaatcgagcatcgtgggtagtgttttttcagcccctgtgactaagtaggttataaatggtcctcagtcatcatcatcataaatgattcaaggcctgaatggcagaagaagaagaggaaaactcaagtgaaaagtgctagacatagaacacagcttacctaataaaacatgctactggctaactaagctggggtggctttctgccccctctacttaaatttaagaaagaaaaacagaaacgtctctgcatctgccactgcataccctctcagagcacagaccaactttgcccttccttaaaagtcccagggtttacctaccaacttttaggaaataaataaccagcctcaaagcttggcaaagagggcatcagtatcagctctagaggtttgctccgatttatatctcctcctccagtaaagtcttctgctcccactcccagccaaccccgctcaacgcccacccctcactgcggcactggacgcgcgggggatgcggggttgttcccagagtagccgctaaggggagccggacgctagaccgccctcccgcgttcccatgacaacgacaccggcgggcgcgtagcctggagagcgaagtgccggctacagcaggtgtcggattgcagtgcgctcgctgaggctccggaccttggagcgtctagagtctggctactgttcctccgcctccctctcgggcagctccctaagccggctgggacgcgcagagtgaaaatggtccaccattcaggctccattcagtcctttaaacagcaaaaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaggagaattgattacatcttggtttatagaaagacaaatataccatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaagactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctgtactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatggggcaatgcagtgaacattggcatcctcatttaattaaaaccactgtgcccaggtgaagtattgaaaatagattttacctggttcatttctgtcgtcataaagtcgccgatgggaaaatgaatccgttttcctttttccacacaacaagtagcccacaagagtaagcaatgagacacccagaatagcacctaaaatggccccg

SEQ ID NO: 280988 - DNA, 6125 bp, Homo sapiens
cgcgctgtgtgtgtgtgtgagtggagagtgagtgcgggacctgaggctgtgtgtgtgtgaactgtggccactggcggggtcgggggggggcagcggcggagccgcctcggacgataaggaaattgagatttggagaagttaaataaccaagacttcacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtctttgtgttgctgttttgttatgaacgtgcttgctctcttgcgaggcacctgtccattccacatcaccgaggggtctacgagagcactgccaagtgttcctgtggaccagcatgacctctccacagcctgcagtgagcccca

SEQ ID NO: 280989 - DNA, 7041 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 280990 - DNA, 5926 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggaggaaagtagcttatactcacagtgtctgcccctgccgtgtagctctctcatggggagggcctgtttttgtaagggtaatgtggagagagaggtcagggctttgttccctgtggacgcagctctctgttgtcatgttctggatc

SEQ ID NO: 280991 - DNA, 5598 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaatctacgattttactccaccgccttcacctattctttgggattcattcctgatagtaaatatagcctttctcatcaatctccattgtgtggtctattaccctctcaaactcactattcac

SEQ ID NO: 280992 - DNA, 5196 bp, Homo sapiens
gggcggatcgtgtcaccacaaccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 280993 - DNA, 7003 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 280994 - DNA, 7020 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggagtgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 280995 - DNA, 6987 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgaggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 280996 - DNA, 6788 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccagctgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 280997 - DNA, 5294 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtctttgtgttgctgttttgttatgaacgtgcttgctctcttgcgaggcacctgtccattccacatcaccgaggggtctacgagagcactgccaagtgttcctgtggaccagcatgacctctccacagcctgcagtgagcccca

SEQ ID NO: 280998 - DNA, 892 bp, Homo sapiens
gggcggagccgcctcggacgataaggaaattgagatttggagaagttaaataaccaagacttcacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcagtaggtttgcttcttacttttctccagcgattatcatctgtagatgctgtatctttattgttttttcgtgaatagtttgccttctcctaaggccttgaccaagttgggagtagagttttttgccaaagtcctggttgtggccataatgctttctctttggtatgtactttgatattggtgaggcctcccaaggtatctacgctcattcttgggcaaaatgattttgaatttgagaatataggggccctcttcagtttttcaatggaaaaataagagtgatgcatacagcatgattctgcactgacactgtggggtatgcattgggcatgtagagggatagaaagttgctttctgtctatcttgaggaggatgtgaggagtaaataagaatatacatattttactcagctcctgaacatagtaattgctcaacaaattgtggctgataggtttgtttttggaggtgggatggcatgatgcttgagaacgtgggctttgggggtccatgttttggatttaaatccagctccatagttcactgacagacttaagcctct

SEQ ID NO: 280999 - DNA, 510 bp, Homo sapiens
tagaggatctttaaaggcgagctggctaaaactctccaggtgcagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtctttgtgttgctgttttgttatgaacgtgcttgctctcttgcgaggcacctgtccattccacatcaccgaggggtctacgagagcactgccaagtgttcctgtggaccagcatgacctctccacagcctgcagtgagcccca

SEQ ID NO: 281000 - DNA, 135 bp, Homo sapiens
ggactccaaagctgagctcactaccctgctggagcagtgggaaaaggaacatggcagtgggcaggacatggtacctatccttaccaggtatgaataacttttttaaaacctagtttaataaaaaacctcggacac

SEQ ID NO: 281001 - DNA, 302 bp, Homo sapiens
ctataggtgtatgtattcaaatcctagtggcttctgaccatttcttggtttctggggattataaaattgtctctttaattcaacaacatttttatgcaaatctttaaaaatgctaatggcaggtagtgacatctgcatgtatgtaaatacgtggttacccaccttgcgcctttttcttttaggatgggtccttgctgctgacatctgctacttggagccagcctttgtctgcactttggggaatgaagtcagtatttgatatgaagtatgtatctgcttttggaacctagtctgtgctttat

SEQ ID NO: 281002 - DNA, 474 bp, Homo sapiens
taagttgcaggcctgtcatccctaaataccctagcagatgcttgttaggataagaaaattttacataagtatttcttgaggctttatattatcccatcatggggacaatattgtcatttaaccccgcacaacaactgtttccatcttgcagataaggaaattgagatttggagaagttaaataaccaagacttcacaggtatgtcagcagagttgggatttgaatccttgaaaccttttttctacctagtactagctggtcttggggacctctctgagctagtttcctcatgtgtgaaaaagggtaggatggttgtgaaaattcagaataatgtaagtatggtaaattacttagctcaatgtctgtcccatactagatattcactaattggtaactaccgtgtcaccattggacagaccatcatttcttcatagcacttaaaggaactcacttaagaacttgagtaatgcaccc

SEQ ID NO: 281003 - DNA, 3957 bp, Homo sapiens
gactctatatgatcccctgccttcatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 281004 - DNA, 6986 bp, Homo sapiens
agcagggcagagggggctcccctcaggaacatcatgagacttttcacacagagacatcgccacctctaagggatgaagaacttccccacgataaggaaattgagatttggagaagttaaataaccaagacttcacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 281005 - DNA, 5766 bp, Homo sapiens
gactctatatgatcccctgccttcatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 281006 - DNA, 5481 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccatttcctaggatggacatatctttcaaggggaaaaaaaaaccatgtctctggggtatttc

SEQ ID NO: 281007 - DNA, 6992 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgttatggcctttccctattttcttttaccgaagtggggtgtgtcccttttttgcagctctagccaggccatagagaagacaccttccaggagaggcaaggagagcatgttctgcccacatagagcactccagggagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 281008 - DNA, 6347 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaacactgacagctctgacaactctgatttggaagatgacatcatcttatctctgaatgagtgaggagccatcactgcttggaagagattcttggcagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 281009 - DNA, 5484 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaacactgacagctctgacaactctgatttggaagatgacatcatcttatctctgaatgagtgaggagccatcactgcttggaagagattcttggcagagaagaggggacaaatttggttgtgaagtaaacaagaaacacaagacggctaaaactctccaggggcagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgt

SEQ ID NO: 281010 - DNA, 3890 bp, Homo sapiens
gggcggagccgcctcggacgataaggaaattgagatttggagaagttaaataaccaagacttcacagacaaagtctcactccttttgcccaggccggtgtgcattggggtaatctcggctgactgcaacctccgtcccctccgagttcaagtgattctcctgcctcaacctcccgagtagctgggattacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagtatgtatctgcttttggaacctagtctgtgctttatttacctagtttataccccccttcatttggttcttagactggaagccttttggggaaagaggatgctgtcggttattgttaacttctctcttcctcatctaagactcatgtttaataagactttatctttcttaat

SEQ ID NO: 281011 - DNA, 1216 bp, Homo sapiens
cagccaggtggaaggcgccccgcttgcagcaaggtaacgcgcagcagccccagccgtccgcagtgaaacagccggagcagaagatacttttatttctcggcccgtattaacactcagctctacaaaataacctataggttttaacttccttctctttcattgaaaaaggttccttgaaaaatcctgtcctcccattccccggggttcccttacttttagttcatacagataatttccctgtcagatttcctcattgcattttgaactcataaaacatgcacataaaaatagcatgttacaaatttatggagaaaatgggctctgtctcttaaatttgttgactcgaaacattttgggtggggggtcttttttcgtttttagaagaaaggctttttagaaaactatgtacataatctgacttctcctccccgcattgcaacgccgaaaataaaatttttcacaatgcatttacaagaaataatacaaaacccaaaaaaaaaaatggaaatgctcagatacataaagttttacaaaacccagaatataactccgccgtctgaaggagggggtggtggtggtaatctctttgtataaattaacaaaccaacccaaaagagcggtaacaactacaaaaaacttgtaagtgcttggacctgccttactacatttataacaaatgcgacgagctccgcgtcacttgggctccggcggtcggcgccgtccggaagcaacgcggaggaaagtgagcgcgccggccggtatacaaaagtgggcttcgcctctcgcctcgttttgacttttttgtcccctcgagcaaagaaaacgctttccgcttcctccgtaggtgataaatactgtacaaaaagtctcaagaaaacaccgaagttcagtctaaaacccaagtctggtgtcagcgcccggcggtcgccagggtctccggggaaggtgagtgggggacacgcgtcacccggcgttcgtctccagtattttccttttgacaagaatgtgggaacgtctgtacaaaagccaggccgcgccggggcggggcgggagccgggcgcgggccgcgagctcgtgggtcgccgccgcagagtccccggcgtcccgaaggcgctagatgtgcgtcaggggcaccgtgccgttcacgcccacgcccgcgcccgcgccctggtagtgctgcggcagcgagtgcagccggctctgcgccgcggccgca

SEQ ID NO: 281012 - DNA, 134 bp, Homo sapiens
ccaaggtggcagagtcaggtagggccctacccccagccccgcctccagagcagcgagtgctacccagatgcatgatgtacaggaacatgcaatagaaatgctgaaaagtgacgaggattcaaacggaacttgtc

SEQ ID NO: 281013 - DNA, 1538 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagggctggtcacagaaggctctgggctccaacctggcttgctggacgtgctcttgaagcccccaagtaagaagtctgagtccctgagaccaccacactgcaaggacacttgaaggtactcaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaa

SEQ ID NO: 281014 - DNA, 2087 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaaaaa

SEQ ID NO: 281015 - DNA, 1462 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaat

SEQ ID NO: 281016 - DNA, 1001 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctg

SEQ ID NO: 281017 - DNA, 1310 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgc

SEQ ID NO: 281018 - DNA, 819 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttagtgtacccgccaggaagcacctacgaccaggattatggattccctgccggtcgtttttcctaaggaatca

SEQ ID NO: 281019 - DNA, 719 bp, Homo sapiens
gaggacacacagaagtcaccatctataagaaacaggctcccaccagacactgagtctgctggagccttgatcttgaatttcccaacctccagaactgtggccaccagactttctctgcttgtatcctcccaggaccacagaactcatcgcatcccaaggcagcctattccatcatggatgagctcaaagtgtttgaaagttctgctttatcaagtgagccaaacttcctccctcaggaccatccactccagggcccagttattctactggaggagtgagggtaaagccatcaccaggacaaccttggtgacaggctggactggcagccagcttttggggatgacttcagggaaccctgaatagccatgggagccaaatgtattactcctctgatgcctacaattccactataatagtctggtgggcttctgttagggaggcttatacatggtggaaagaataaaggcttggactcagcctaggttcaagtactgcatcttgacctggcctgtaggcaagtcttttcacttctctgagttttggctttctcatttgtccaataggaataacaataatgataataataatacctcccatgcaggattgctagtatgttcaatgggataatatatctaaacacctcacacaatgcctggcacatagcaggtgttcaattaggtctgtattaaaatccaggctctgtctcttattaataaaaa

SEQ ID NO: 281020 - DNA, 528 bp, Homo sapiens
gcggccgctttccgcctcggactcgagcgcgtcgaagacagcagcgcccaccagcagatgcagagaacccaaagccctgcaggatggcaaagctgcaacatggaagtcacccggatcaccacgtaaaggaaatctctccaaccaggaacaaacacctgccttgcaatattaggtccttcctagggcttggtgcatgtgcatatctccttccggaatcctggtcaatactaaggtgtctgcctcctgccccggtccacagccaggagccccggagccaacggcaagcctggaagacttacagttctccctctgagggttgctgtggctttccatgttgtggtgactaagtccctgtgtttctgtgcagtccctgcttcctgggaccagggaagaatggtcccgtacccgctattctgacctctgtggccactgattagttgttcctgaaaggaacagttttaagccacttctatctctgaggcaagaaggaagacgggagaaatgaggaggtgtgaggaagagagttgg

SEQ ID NO: 281021 - DNA, 1420 bp, Homo sapiens
gaggacacacagaagtcaccatctataagaaacaggctcccaccagacactgagtctgctggagccttgatcttgaatttcccaacctccagaactgtggccaccagactttctctgcttgtatcctcccaggaccacagaactcatcgcatcccaaggcagcctattccatcatggatgagctcaaagtgtttgaaagttctgctttatcaaaactcttgatggcctgcttcccatcctccatcctggaagactgatctgaaaccccaggaggaggtcctctgagccctgaggcagagatctctcacctggaagatgggtctaatgactgcgccccacacacaccagagaggactgcagatagtgcgggatgagaggaagatctctggccctggagacagcatcatcaagcggtagcttcatctttgggagctggggcctctgcaggagctttaccctcctctctccatgctgagcctgtctcaaccccctaacctgcaccccagtcttttggggtcacctcaaggctttggctgatgcttctttgctgacgtcaaccaagaaaacgtatgaggaagaaaatagcagatgagaagaatcaaccaaattccggaagctggaaggcagatgcaagaaggcccttgaatgatgccagcaccttgatattggactttccagcctccagaaccatgagccaatacatttctgttccataaaaattacccagttccaggtattctgctatagcagcacaaaatggactaaaacaatgttggcacaagactcagtgctgggcctggcatgcaacaggtccttggagtggcgtgctgtgtggataatgaatattggggaaggcatctctctccagcccctctcaagctttctgtagtcactggtccactctgtattgctatgaagaagctcaagaccagcctgtatcactcggggtcctggcaggaaccaggtgccacactcaaactgagtaattgaagagggtttaatatgggagttatttacataggtgtgggctggtgtagctgcccatatgccctcaaaatcacctctacatggcaatagctacttactgctaacagagtctctctctcattgctgcaaatattttctagccatgcaagaaactcagccggtcatgttgaacaaactaagagtgccaggaagttaatgtcctggaagcattgccagaggggagggggcagttagattccccagcttcctcgctcctctgctgggttaagcctgcaacatattcatcatctcccagagtgctgcccggggatagagctccaggtgctcagtgtggtgacctgctcatgtcagcttcttcccctttcctgtcttgtttcgcacccacatccttcccatgtttcctcttcccaaataaactacttgcattggaaat

SEQ ID NO: 281022 - DNA, 964 bp, Homo sapiens
gcggccgctttccgcctcggactcgagcgcgtcgaagacagcagcgcccaccagcagatgcagagaacccaaagccctgcaggatggcaaagctgcaacatggaagtcacccggatcaccacgtaaaggaaatctctccaaccaggaacaaacacctgccttgcaatattaggtgtctgcctcctgccccggtccacagccaggagccccggagccaacggcaagcctggaagacttacagttctccctctgagggttgctgtggctttccatgttgtggtgactaagtccctgtgtttctgtgcagtccctgcttcctgggaccagggaagaatggtcccgtggccaccagactttctctgcttgtatcctcccaggaccacagaactcatcgcatcccaaggcagcctattccatcatggatgagctcaaagtgtttgaaagttctgctttatcaagtgagccaaacttcctccctcaggaccatccactccagggcccagttattctactggaggagtgagggtaaagccatcaccaggacaaccttggtgacaggctggactggcagccagcttttggggatgacttcagggaaccctgaatagccatgggagccaaatgtattactcctctgatgcctacaattccactataatagtctggtgggcttctgttagggaggcttatacatggtggaaagaataaaggcttggactcagcctaggttcaagtactgcatcttgacctggcctgtaggcaagtcttttcacttctctgagttttggctttctcatttgtccaataggaataacaataatgataataataatacctcccatgcaggattgctagtatgttcaatgggataatatatctaaacacctcacacaatgcctggcacatagcaggtgttcaattaggtctgtattaaaatccaggctctgtctcttattaataaaaa

SEQ ID NO: 281023 - DNA, 1009 bp, Homo sapiens
gaggattcccccagtcaagaactgaggctggagactgctgtttaaacatggcaggttgaacacacttatttctctccattgttctctgaaattccaagaaaatgacacagggattttttttttaaatgcacatctatctactgggacaaagaaaacgtatgaggaagaaaatagcagatgagaagaatcaaccaaattccggaagctggaaggcagatgcaagaaggcccttgaatgatgccagcaccttgatattggactttccagcctccagaaccatgagccaatacatttctgttccataaaaattacccagttccaggtattctgctatagcagcacaaaatggactaaaacaatgttggcacaagactcagtgctgggcctggcatgcaacaggtccttggagtggcgtgctgtgtggataatgaatattggggaaggcatctctctccagcccctctcaagctttctgtagtcactggtccactctgtattgctatgaagaagctcaagaccagcctgtatcactcggggtcctggcaggaaccaggtgccacactcaaactgagtaattgaagagggtttaatatgggagttatttacataggtgtgggctggtgtagctgcccatatgccctcaaaatcacctctacatggcaatagctacttactgctaacagagtctctctctcattgctgcaaatattttctagccatgcaagaaactcagccggtcatgttgaacaaactaagagtgccaggaagttaatgtcctggaagcattgccagaggggagggggcagttagattccccagcttcctcgctcctctgctgggttaagcctgcaacatattcatcatctcccagagtgctgcccggggatagagctccaggtgctcagtgtggtgacctgctcatgtcagcttcttcccctttcctgtcttgtttcgcacccacatccttcccatgtttcctcttcccaaataaactacttgcattggaaat

SEQ ID NO: 281024 - DNA, 795 bp, Homo sapiens
gcggccgctttccgcctcggactcgagcgcgtcgaagacagcagcgcccaccagcagatgcagagaacccaaagccctgcaggatggcaaagctgcaacatggaagtcacccggatcaccacgtaaaggaaatctctccaaccaggaacaaacacctgccttgcaatattaggtggccaccagactttctctgcttgtatcctcccaggaccacagaactcatcgcatcccaaggcagcctattccatcatggatgagctcaaagtgtttgaaagttctgctttatcaagtgagccaaacttcctccctcaggaccatccactccagggcccagttattctactggaggagtgagggtaaagccatcaccaggacaaccttggtgacaggctggactggcagccagcttttggggatgacttcagggaaccctgaatagccatgggagccaaatgtattactcctctgatgcctacaattccactataatagtctggtgggcttctgttagggaggcttatacatggtggaaagaataaaggcttggactcagcctaggttcaagtactgcatcttgacctggcctgtaggcaagtcttttcacttctctgagttttggctttctcatttgtccaataggaataacaataatgataataataatacctcccatgcaggattgctagtatgttcaatgggataatatatctaaacacctcacacaatgcctggcacatagcaggtgttcaattaggtctgtattaaaatccaggctctgtctcttattaataaaaa

SEQ ID NO: 281025 - DNA, 1516 bp, Homo sapiens
gcggccgctttccgcctcggactcgagcgcgtcgaagacagcagcgcccaccagcagatgcagagaacccaaagccctgcaggatggcaaagctgcaacatggaagtcacccggatcaccacgtaaaggaaatctctccaaccaggaacaaacacctgccttgcaatattaggtgtctgcctcctgccccggtccacagccaggagccccggagccaacggcaagcctggaagacttacagttctccctctgagggttgctgtggctttccatgttgtggtgactaagtccctgtgtttctgtgcagtccctgcttcctgggaccagggaagaatggtcccgtggccaccagactttctctgcttgtatcctcccaggaccacagaactcatcgcatcccaaggcagcctattccatcatggatgagctcaaagtgtttgaaagttctgctttatcaaaactcttgatggcctgcttcccatcctccatcctggaagactgatctgaaaccccaggaggaggtcctctgagccctgaggcagagatctctcacctggaagatgggtctaatgactgcgccccacacacaccagagaggactgcagatagtgcgggatgagaggaagatctctggccctggagacagcatcatcaagcgaaaacgtatgaggaagaaaatagcagatgagaagaatcaaccaaattccggaagctggaaggcagatgcaagaaggcccttgaatgatgccagcaccttgatattggactttccagcctccagaaccatgagccaatacatttctgttccataaaaattacccagttccaggtattctgctatagcagcacaaaatggactaaaacaatgttggcacaagactcagtgctgggcctggcatgcaacaggtccttggagtggcgtgctgtgtggataatgaatattggggaaggcatctctctccagcccctctcaagctttctgtagtcactggtccactctgtattgctatgaagaagctcaagaccagcctgtatcactcggggtcctggcaggaaccaggtgccacactcaaactgagtaattgaagagggtttaatatgggagttatttacataggtgtgggctggtgtagctgcccatatgccctcaaaatcacctctacatggcaatagctacttactgctaacagagtctctctctcattgctgcaaatattttctagccatgcaagaaactcagccggtcatgttgaacaaactaagagtgccaggaagttaatgtcctggaagcattgccagaggggagggggcagttagattccccagcttcctcgctcctctgctgggttaagcctgcaacatattcatcatctcccagagtgctgcccggggatagagctccaggtgctcagtgtggtgacctgctcatgtcagcttcttcccctttcctgtcttgtttcgcacccacatccttcccatgtttcctcttcccaaataaactacttgcattggaaat

SEQ ID NO: 281026 - DNA, 426 bp, Homo sapiens
gctttgacccttgcagcattttgattggctccagcgtgtacggggtcgaccttggtggcgtatcagcttggtactctcattggctaacgttccagggtcgaaggacaggtaaagcgtctgctccttccgctgctgccggcagataaggatgcccgtggcagccacagcagtagcaatgatggcggcgatgatgcccccgatgatgccgcctgtggcccctgcgcctgctgtgttgggggtctctgcaaggagagggacagcgtgagggggtctccaggaggaagccacagctccttattccaagcgaccatcccaccccacatcatcgcctgcctgtctatgtcctctcccatgggcaggggacattctttcattcaactcaaactgctgagcatgaggaaggagcgaggatgtgtgccccgcatg

SEQ ID NO: 281027 - DNA, 399 bp, Homo sapiens
acagcccctgtgactgacagaaagggtgttttacttgtctattggagccattgagaggttctaaccagttgcaaggtgggtgaggaggaagcacagaagttgtgtggggtagaaaaagcctggggaaaatggtgcctttaggccacccatcacgtgcctcaagttccaaagaatgtgaacagcaggaaaagagatttgccctctccccactgtcatacatgtgacagtagaaagctgaagatttgagccagaaactggctatcaagattgattcaggttgattcccagggttctgttttatttccacccaggaaacaccagcattcttgaatcctttcagcattaggcaaaggagcagatgtgggcattctgcatctcaaggaggtctttagcaacacc

SEQ ID NO: 281028 - DNA, 445 bp, Homo sapiens
aagcttaaacaggtgggggctggggggaaatggaaggttggctctaggaccagatgcatcaggcttcagtgttgtctgtcaacattatccgtcccttttgagggtagtgtcatctgataacatttttgagtcatgggaaatttccggaaacagaacagcacacagaaaggactgacctatttctcttagagtaacatcctcgtggctcatccactgattgaagaaatatttctgttgctaggagaaaggaccttgaaaccttgaagtattctgtggtatcctgtgtgtacacagttcttcttcaaagagaacttagagacatttacttgggtgacttgacattaaagggaagagattgcctagagcagggggcagcacactgtggactgagaaccaaatcaagccaggcatctgtttttgcaaataaagttttattagaaaacag

SEQ ID NO: 281029 - DNA, 487 bp, Homo sapiens
ttctattcaacatttcctatcccatggcatggaatatattgtgagttacacatagttggcaaagacacaaattagggaaagggtcctgaaggtccagcttaccatatggtggctgagtcaggttaaggcataggaggtggtatgctttgggacagtcttttttgtcacacatgaccagctctccaccatctccacattgaaaacagtaatcttcatgcatctgctttggttctgttttgatctttcgtctcttctgttttaacttagcattttttgccttctcttcatttgttgacgcacatgccgactggcaggaaagaaaggatcatagtttcaaacatcacagacagtgcatgaagctggacacaggaaaaccctgcaaccttgcattcatttaaattcatctgttgtacaattacctaaaaacatcaggaggccttatgctgcaacaaatactataacaaaaataaagttttgttttcactga

SEQ ID NO: 281030 - DNA, 256 bp, Homo sapiens
tcggggagatggggaggaagaaggagaagtgcccaacattttttgccttctcttcatttgttgacgcacatgccgactggcaggaaagaaaggatcatagtttcaaacatcacagacagtgcatgaagctggacacaggaaaaccctgcaaccttgcattcatttaaattcatctgttgtacaattacctaaaaacatcaggaggccttatgctgcaacaaatactataacaaaaataaagttttgttttcactga

SEQ ID NO: 281031 - DNA, 888 bp, Homo sapiens
aaggctgggttgactgcgtgtttgcctttatcgtgcctatcagaacgttgacagtgcgtgtacctccctggtgatgtgcggctcacttgctctttcaggacctacctgacttggaagatgatgatgaaacaggcaaatctctggaagaccagaatatgtgctttccgaagattgaggtcatctcgagcttgagtgatgacagtgaccctgaactggactacacgtcactccctgtgctggaaaacctgcccacagacactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggctgccaagtgtatttagtccctgaacctggatccaaggcatctccctgtaggaaacatcagaccggggcagagattgacaaagcaacccacaacagcagctgccaacggccgctgtgcccacctcatcagcagctctgcaggggcctcactccaccctcaccaaacacgaggagccagcactcctggcccccattccactggacaggaaggcgtgagaactgagggacctgcctgaggcccccacagctgaggcgcagcggagccctgcctcccagcacagactaaaatcgcagcaacacaggcccaccggcacctccagcctgccttgcgggatgatcttcaggcgaatatacaaaatacaaaagaaa

SEQ ID NO: 281032 - DNA, 714 bp, Homo sapiens
aaggctgggttgactgcgtgtttgcctttatcgtgcctatcagaacgttgacagtgcgtgtacctccctggtgatgtgcggctcacttgctctttcaggacctacctgacttggaagatgatgatgaaacaggcaaatctctggaagaccagaatatgtgctttccgaagattgaggtcatctcgagcttgagtgatgacagtgaccctgaactggactacacgtcactccctgtgctggaaaacctgcccacagacactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggtgccgactgagagcgccgccacacccccagagacgtgtgtcggagttgcccagcccagccaagctctgcccacgtgggacctcactgcattcccagcaccgaaagcatcatagttttccccagttatatgtagcataaatggtttaatcataaatgtctcccttaggcatgataaacattttaacacccaaaaga

SEQ ID NO: 281033 - DNA, 807 bp, Homo sapiens
aaggctgggttgactgcgtgtttgcctttatcgtgcctatcagaacgttgacagtgcgtgtacctccctggtgatgtgcggctcacttgctctttcaggacctacctgacttggaagatgatgatgaaacaggcaaatctctggaagaccagaatatgtgctttccgaagattgaggtcatctcgagcttgagtgatgacagtgaccctgaactggactacacgtcactccctgtgctggaaaacctgcccacagacactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggagatggggtttcaccatgttgaccaggctggtctcgaactcctgacctcaggtgatctgtttgcctcggcctcccaaagtgctgggattacagtgccgactgagagcgccgccacacccccagagacgtgtgtcggagttgcccagcccagccaagctctgcccacgtgggacctcactgcattcccagcaccgaaagcatcatagttttccccagttatatgtagcataaatggtttaatcataaatgtctcccttaggcatgataaacattttaacacccaaaaga

SEQ ID NO: 281034 - DNA, 472 bp, Homo sapiens
aagtggtgaagaactttattttctgtagatcatcatgacatcagtttcaagacccacccaactgggagcatgtgaaattttttcttagaaggtcatccaaaatttgagatatttcacatgaagaacatgtatggaggctgacctgtatgccagttcagatccgtagagccaggtttctcttcatggattgctttgcgctcctcctcctgcaagacagtgagtctccacaggcccatgaatgtcataagtgagtgcaagcttgaagaagcacctatcctgtgctcaggacaaaatatctgtggtccagagcagagctcccaacccagctactatgaaccacgctaggccccagaaaagaaaggaaaacagaagagacattggattggatcttccagaaggtctttgttgcaatttttctccatcattgaaaaaaaattacatcatcaaataaagacaatagcagcacagctta

SEQ ID NO: 281035 - DNA, 607 bp, Homo sapiens
aagtggtgaagaactttattttctgtagatcatcatgacatcagtttcaagacccacccaactgggagcatgtgaaattttttcttagaaggtcatccaaaatttgagatatttcacatgaagaacatgtatggaggctgacctgtatgccagttcagatccgtagagccaggcaaatttggttttgaccaaaatgatacttaggagttggataagttacttacgctgccagtcttggctccaaatgacttccgcttcctgaacaaattaaatctgccttgaaggatgaaaatgtgtgattaataaggtttctcttcatggattgctttgcgctcctcctcctgcaagacagtgagtctccacaggcccatgaatgtcataagtgagtgcaagcttgaagaagcacctatcctgtgctcaggacaaaatatctgtggtccagagcagagctcccaacccagctactatgaaccacgctaggccccagaaaagaaaggaaaacagaagagacattggattggatcttccagaaggtctttgttgcaatttttctccatcattgaaaaaaaattacatcatcaaataaagacaatagcagcacagctta

SEQ ID NO: 281036 - DNA, 1835 bp, Homo sapiens
caagactgctcctctctgccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttataacattgtcaagttctgccgagccatagacatcatctactccctgatcaccagctgcaacatgagcaaacgcatggacatcgccatccaagtcacagaaagcatcgcactctttcacagctgcctcaacccaatcctttatgtttttatgggagcatctttcaaaaactacgttatgaaagtggccaagaaatatgggtcctggagaagacagagacaaagtgtggaggagtttccttttgattctgagggtcctacagagccaaccagtacttttagcatttaaaggtaaaactgctctgccttttgcttggatacatatgaatgatgctttcccctcaaataaaacatctgcattattctgaaactcaaatctcagacgccgtggttgcaacttataataaagaatgggttgggggaagggggagaaataaaagccaagaagaggaaacaagataataaatgtacaaaacatgaaaattaaaatgaacaatataggaaaataattgtaacaggcataagtgaataacactctgctgtaacgaagaagagctttgtggtgataattttgtatcttggttgcagtggtgcttatacaaatctacacaagtgataaaatgacacagaactatatacacacattgtaccaatttcaatttcctggttttgacattatagtataattatgtaagatggaaccattggggaaaactgggtgaagggtacccaggaccactctgtaccatctttgtaacttcctgtgaatttataataatttcaaaataaaacaagttaaaaaaaaacccactatgctataagttaggccatctaaaacagattattaaagaggttcatgttaaaaggcatttataattatttttaattatctaagttttaatacaagaacgatttccctgcataattttagtacttgaataagtatgcagcagaactccaactatcttttttcctgttttttttaaatttgtaagtaattttataaaatccacctcctccaaaaaagcaat

SEQ ID NO: 281037 - DNA, 1459 bp, Homo sapiens
caagactgctcctctctgccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttataacattgtcaagttctgccgagccatagacatcatctactccctgatcaccagctgcaacatgagcaaacgcatggacatcgccatccaagtcacagaaagcatcgcactctttcacagctgcctcaacccaatcctttatgtttttatgggagcatctttcaaaaactacgttatgaaagtggccaagaaatatgggtcctggagaagacagagacaaagtgtggaggagtttccttttgattctgagggtcctacagagccaaccagtacttttagcatttaaagctcatccataataactccgggacgactgactacacaaggagagaatggtgattggcatttacctgtcatacagaagcaagagcaatcaaggcatagtccacgtggctgagtccgctgacagctggcaaaaacaagttccagagaccctcgactttggccatttcctgtcaaggtgatgaacatgccagagtgaccataatttaccaggactcacagtagtttatttctttttttaaatattggtatttatgatctttgaaatttaaaaacacttatggagttatttattttactgtattctccagtgagcaaaaccaagttcttattaattcattataaatcaacagtttaaccattaataaca

SEQ ID NO: 281038 - DNA, 402 bp, Homo sapiens
atcttggggtcatattccaatgtggctcccattaaagcatttcaaagagtgctagattcaggctcacatatgttacagcaacaggctatactctagggaaagaacaaaacagcttgataaaaactgtttccttttaagcatatttagacaaatatctatcctgtattctctttgccatctagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaaga

SEQ ID NO: 281039 - DNA, 2184 bp, Homo sapiens
caagactgctcctctctgccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttataacattgtcaagttctgccgagccatagacatcatctactccctgatcaccagctgcaacatgagcaaacgcatggacatcgccatccaagtcacagaaagcatcgcactctttcacagctgcctcaacccaatcctttatgtttttatgggagcatctttcaaaaactacgttatgaaagtggccaagaaatatgggtcctggagaagacagagacaaagtgtggaggagtttccttttgattctgagggtcctacagagccaaccagtacttttagcatttaaaggtaaaactgctctgccttttgcttggatacatatgaatgatgctttcccctcaaataaaacatctgcattattctgaaactcaaatctcagacgccgtggttgcaacttataataaagaatgggttgggggaagggggagaaataaaagccaagaagaggaaacaagataataaatgtacaaaacatgaaaattaaaatgaacaatataggaaaataattgtaacaggcataagtgaataacactctgctgtaacgaagaagagctttgtggtgataattttgtatcttggttgcagtggtgcttatacaaatctacacaagtgataaaatgacacagaactatatacacacattgtaccaatttcaatttcctggttttgacattatagtataattatgtaagatggaaccattggggaaaactgggtgaagggtacccaggaccactctgtaccatctttgtaacttcctgtgaatttataataatttcaaaataaaacaagttaaaaaaaaacccactatgctataagttaggccatctaaaacagattattaaagaggttcatgttaaaaggcatttataattatttttaattatctaagttttaatacaagaacgatttccctgcataattttagtacttgaataagtatgcagcagaactccaactatcttttttcctgttttttttaaatttgtaagtaattttataaaatccacctcctccaaaaaagcaataaaaaaaaaacaaactataataagcttttctgattcttttcaaaacattcctggtaagttcctaaagacataatttgcttctatgatgtcaactttcttactaataactggttatcatgacaaatgttaggtttatcatatatagtctaggtgtaatcctcagactatcattttcatctgggttccaatttcttaacttcctaaagaattcatctgtttatacaagtctaccactgccgattgactaaaaaatacattatcccatgcataaaatgtcctattttcatttaaacactttatttttgagtaataaaaatatgtaccacaataaattattgttaattaacat

SEQ ID NO: 281040 - DNA, 811 bp, Homo sapiens
gccgggagtggcgagcttgccgttgtgcatgagtggcgtgaggatggcctccggctttgggtctttggattgagtgtccccaaagaggccgctgagcttggtgacgctgctcatggagccccggcgcgagtgggtgagctccttctccttgcgctgcaccacagccacgtctttgcgccgatgatcacagacgcagtagacggtgatgcccgagaagacggcccccatgacgaaagccaggatgactgcaatggccaagagggtgacgggaaccagctggtcgtggcctttgagggtcctcctcccttcaattgtgacatcacagttggttgctgtggaaatgattgtcctgtgacaaaggattgtgacttaagtagaagcagcaaatatctcttaagaaataaagattctgtgatccaacaaatacccttggtaataaaaggcagtcaaggcaattcaccataaggaaagagtgtacaagacggaaaaatacaacagagaaagataacaggccgactcacgtgaatataaaacgagcgggaagggcagttggcttagaaaattcccttgccagctacttttttaagcccaaattggatcacagaactgtgatgtacaaatggtgttgtgattattggttgccatgagccaaatgaaccatgcagaatgctaattgggcaggaaaccagctttcaggtactccagattgaagacgaaacaaaggagaccaaaaggactgtctgaaaaccgtgtgaatgcattcacgctgataaattttttaaaaataataaattcttttcaattaaaaaaa

SEQ ID NO: 281041 - DNA, 1178 bp, Homo sapiens
gccgggagtggcgagcttgccgttgtgcatgagtggcgtgaggatggcctccggctttgggtctttggattgagtgtccccaaagaggccgctgagcttggtgacgctgctcatggagccccggcgcgagtgggtgagctccttctccttgcgctgcaccacagccacgtctttgcgccgatgatcacagacgcagtagacggtgatgcccgagaagacggcccccatgacgaaagccaggatgactgcaatggccaagagggtgacgggaaccagctggtcgtggcctttgagggtcctcctcccttcaattgtgacatcacagttggttgctgtggaaatgattgtcctgtgacaaaggattgtgacttaagtagaagcagcaaatatctcttaagaaataaagattctgtgatccaacaaatacccttggtaataaaaggcagtcaaggcaattcaccataaggaaagagtgtacaagacggaaaaatacaacagagaaagataacaggccgactcacgtgaatataaaacgagcgggaagggcagttggcttagaaaattcccttgccagctactgtgagtgtgcatggggggagggggtggaagggggtggaagggcgtggtaaggggtggaggagtaggggcctgttttgtaaattgctgaataggcaagtttcttcaaacttcagtaggctgccagaatcaccctgccctttaatttcaaggcagttttattgcatttgtttattacttgcttgactttattggtggtgctgtggtcagactcattattggaatggaattgcctattactttgctatcaggtttgagatgactcgaggcttttccttgcctgcctcccctcagaacttaagtttgagctgaacatatgaattgtaaatgaacaactgattaatatgcattggcagctcctcagaaagctctcagattgcccccttttggcatggcctgtttatgttaattagcagtttagagattaaaaaagaagaggaatttacaaagtggataataataaagcagaattgaaaggggttcttgccaccaaccctcactcagtcccccgggttctggatgggacttggcttgcgattgctgacagcaattgtctagaagaactgggaagccttttaaacacagaattctgtgaatgaaat

SEQ ID NO: 281042 - DNA, 1051 bp, Homo sapiens
gccgggagtggcgagcttgccgttgtgcatgagtggcgtgaggatggcctccggctttgggtctttggattgagtgtccccaaagaggccgctgagcttggtgacgctgctcatggagccccggcgcgagtgggtgagctccttctccttgcgctgcaccacagccacgtctttgcgccgatgatcacagacgcagtagacggtgatgcccgagaagacggcccccatgacgaaagccaggatgactgcaatggccaagagggtgacgggaaccagctggtcgtggcctttgagggtcctcctcccttcaattgtgacatcacagttggttgctgtggaaatgattgtcctgtgacaaaggattgtgacttaagtagaagcagcaaatatctcttaagaaataaagattctgtgatccaacaaatacccttggtaataaaaggcagtcaaggcaattcaccataaggaaagagtgtacaagacgtacagaaactgattcttcactgtatgccatggttggctgacagtaaggttaaagtggaggtggctgaggacttctcccattaaaagttcaagttcttcctgatgttaaccacaagatgatgccgacatcaacgattactctttcaacgtaaataaaaacaaagcatagaatggaagattgtgtgtttattttatgtcacaaaaggaaggcaagcctggaaatgccaacctcccatcatattaattttaatgccagatgctccagcgttccctgatgtacaaagctgctggttgaagtgtgtttttatgttgttatatgaccacaggcacaaaaccctgcatgtctgcggcagccttttatgagctcttccacagactccctgtgggccttggactgcggaggtgggcatcggcgtacactcagaagacaagactctgggcagccggctttgtgtccataatcctgtgtgcgcctaagtagttcatgatgcaggcctagcagctgttgtaatgtttcatcacattaaaagcaaactatttttgcaaattaaagccttcagtaagttga

SEQ ID NO: 281043 - DNA, 9038 bp, Homo sapiens
  misc_feature (2440)..(2440): n is a, c, g, or t
  misc_feature (7695)..(7695): n is a, c, g, or t
gcgatcggcctttttttctttctttttttttttcctcaaagctgttttctgatatatgttgggtaccatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaagctgaacagctgccagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacggcaccaccacngaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctngatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggctaaaa

SEQ ID NO: 281044 - DNA, 9325 bp, Homo sapiens
  misc_feature (2727)..(2727): n is a, c, g, or t
  misc_feature (7982)..(7982): n is a, c, g, or t
gcgatcggcctttttttctttctttttttttttcctcaaagctgttttctgatatatgttgggtaccatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaagctgaacagctgccagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggggaaaagctgagagtctggaactagcctatcttccgaggacttagagacaacagtatgggaatttcaacgagacgtttttactttcttttgaccaagattcaaattctttattccagcccttgataagtaaataagaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacngaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctngatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggctaaaa

SEQ ID NO: 281045 - DNA, 9185 bp, Homo sapiens
  misc_feature (2587)..(2587): n is a, c, g, or t
  misc_feature (7842)..(7842): n is a, c, g, or t
gcgatcggcctttttttctttctttttttttttcctcaaagctgttttctgatatatgttgggtaccatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaagctgaacagctgccagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacngaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctngatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggctaaaa

SEQ ID NO: 281046 - DNA, 3584 bp, Homo sapiens
  misc_feature (2727)..(2727): n is a, c, g, or t
gcgatcggcctttttttctttctttttttttttcctcaaagctgttttctgatatatgttgggtaccatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaagctgaacagctgccagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggggaaaagctgagagtctggaactagcctatcttccgaggacttagagacaacagtatgggaatttcaacgagacgtttttactttcttttgaccaagattcaaattctttattccagcccttgataagtaaataagaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacngaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggtgaattcctttctagagatataaaccggtcaagctcctcgaggagtgctagcacag

SEQ ID NO: 281047 - DNA, 537 bp, Homo sapiens
tcttttcctcaatctaaagaattaaacttagttatttatcttgtaaaactattgaaaagttagaatatcacttatttttttcctgatagtatataaactcaacacttgtaccctctttttgcatgttcctaaatttttcagtctcctgtattttcagggaggctacatgatttactgtactgttaaaagctttgagttaaattccagttccaccaaacagaccgtgtgaccttaagaaacttgcttgtcctcagttttctcttttttctggtaaacacagttattaacgcctacatctcaaaggagtgcttaaagaattaaagtgaaacaatgtaaggaacataaaagtcctcctatatagaaggttctaagcaactaattcatgattatattattctatagtgattgctgctattatgtgtcaaaattcttggaattgattattctaaaataacagtgaaattagtattttagtattcaatcattttttaatgcaagagccatttctcccaaatgccctttgttatttcctaacta

SEQ ID NO: 281048 - DNA, 495 bp, Homo sapiens
tcttttcctcaatctaaagaattaaacttagttatttatcttgtaaaactattgaaaagttagaatatcacttatttttttcctgatagtatataaactcaacacttgtaccctctttttgcatgttcctaaatttttcagtctcctgtattttcagggaggctacatgatttactgtactgttaaaagctttgagttaaattccagttccaccaaacagaccgtgtgaccttaagaaacttgcttgtcctcagttttctcttttttctggtaaacacagttattaacgcctacatctcaaaggagtgcttaaagaattaaagtgaaacaatgtaaggaacataaaagtcctcctatatagaaggttctaagcaactaattcatgattatattattctatagtgattgctgctattatgttccttacattgtttcactataattctttaagcactcctctgagtgtgggaaggaggaggaggaggtcgcgggatc

SEQ ID NO: 281049 - DNA, 843 bp, Homo sapiens
aagcagtcgtatcaacgcagagtgcccattacggccggggcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtga

SEQ ID NO: 281050 - DNA, 877 bp, Homo sapiens
  misc_feature (824)..(824): n is a, c, g, or t
  misc_feature (869)..(869): n is a, c, g, or t
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttccttaaaagaacaggaagtangcttttaattcaaaaccatgggaaatggtaaattggaacccgggnaaaaccca

SEQ ID NO: 281051 - DNA, 857 bp, Homo sapiens
  misc_feature (809)..(809): n is a, c, g, or t
  misc_feature (816)..(816): n is a, c, g, or t
  misc_feature (818)..(818): n is a, c, g, or t
agaagcgggaggagaaatcggctaggtcgaggctgggtgttaatcggccgaggcgtgttacactcctgtggcaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtggactgaaggtaaatgaantttgggngncaaaatgggggggctttttggaaagtcctggggcccaaa

SEQ ID NO: 281052 - DNA, 607 bp, Homo sapiens
tggccaggtgcagtggctcacgcctgtaataccagcactttgggacgccgaggtgggcagatcacctgaggtcgggagttcgagactatcctggccaacatggtgaaatcctgtccctactaaaaatacaaaaattagctgagcgtggtggtgtgtgcctgtaatcccagctacttgggaggctgaggcaggagaatcgcttgaacctgggaggcagaggttgtggtgagccgagatgaggtcattgcactccagcctgggcaacaagtgtgaaactccgtctcaaaaaaaaaaaagtttccttaaatagttactggctttatttaaggacttctccatcgcccaacacacatcctttataacagactgaagttggcagagaacagaatgatttatttttagggtaaatggaagtttgttctcagcctcttggtttcacttactgtttaaaaccattgttttgcagctatcagttgagggatttgcagttgataaaatggctggagaggttaaggtaaggaaaatactgtttactcttcacttttcagtctagtaagtaaaaacaataacctggttgtaattatagtgttggggataacactgtagc

SEQ ID NO: 281053 - DNA, 697 bp, Homo sapiens
  misc_feature (691)..(691): n is a, c, g, or t
tggccaggtgcagtggctcacgcctgtaataccagcactttgggacgccgaggtgggcagatcacctgaggtcgggagttcgagactatcctggccaacatggtgaaatcctgtccctactaaaaatacaaaaattagctgagcgtggtggtgtgtgcctgtaatcccagctacttgggaggctgaggcaggagaatcgcttgaacctgggaggcagaggttgtggtgagccgagatgaggtcattgcactccagcctgggcaacaagtgtgaaactccgtctcaaaaaaaaaaaagtttccttaaatagttactggctttatttaaggacttctccatcgcccaacacacatcctttataacagactgaagttggcagagaacagaatgatttatttttagggtaaatggaagtttgttctcagcctcttggtttcacttactgtttaaaaccattgttttgcagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccaatcccaggggtacccgagcctcgaaattccgtaaatcatggggcataagctggtttcctggggngaaaaa

SEQ ID NO: 281054 - DNA, 678 bp, Homo sapiens
taatgctacttcaacatatttaattaggctcccatataattgtaattcattacaattagtgcaagaaatctaatgttcttcacctccatatcttcctcatcactcctctgcaactaccccaaaaataaacagaaccatagtggcttctttcccagcagaacaaagccaggactggaacccaggctctaagggatgacaggaatcatgttctattcaactttattattattagttactacatttttttgaggaccatcgttatacattatgagtgagttaaaggcagaaaaatgtaagttagaagggttttcctagaaagcgttttatgtaattcagtattacaggctatctgcttcctgtcataaccctgaatcacactgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacaggtaatctttaatagcttgagatagaaatggagagaaagtattgtcactctatccaggctgggacattttatttttgttctgaatacttaactcaaggtcaggatccatgtaataaataaattag

SEQ ID NO: 281055 - DNA, 506 bp, Homo sapiens
accttggtgtttcattattttacaaaataataattaagagaatataagagtggaatttctctagggaatgggttggaaaatatgtagttatatttttcatatcaagttataaatggattaaagtttggccattgtattcaaagtttggagctaaggcagtcttcggagggtagggctcctcgggattcatttctagtaatttaagatacattggcttgcaacaggattcctttgtgggtttcaatatgaattataataacatatttattagatggttattttgtttatacttttataggttgctgctaaaaccttgcctttttataaggactacttcaatgttccttatcctctacctaaaattgatctcattgctattgcagactttgcagctggtaaagtaaatttcattttattgctgaattgtaataactttttaaaattttgtgacttttgatgcaagagtatatatatatatatatatatcaataaatgtttatatttat

SEQ ID NO: 281056 - DNA, 4385 bp, Homo sapiens
gaattccccgatgtacttctgcattaaattccttgctttcagaatcataaccagggaatcgtttggtactgtgagggatagacaagccctcatttctgtaatccctgctaagtgaggtcaaggctgacatctaagatgttctgtggcggaacctggcccccatcaggggcaacctttaatttggattctggaagactaaaactttgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtga

SEQ ID NO: 281057 - DNA, 4487 bp, Homo sapiens
gaattccccgatgtacttctgcattaaattccttgctttcagaatcataaccagggaatcgtttggtactgtgagggatagacaagccctcatttctgtaatccctgctaagtgaggtcaaggctgacatctaagatgttctgtggcggaacctggcccccatcaggggcaacctttaatttggattctggaagactaaaactttgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281058 - DNA, 4185 bp, Homo sapiens
tccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactgcagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281059 - DNA, 4068 bp, Homo sapiens
agcggacggaagagtcaaggctgggacctcatggcatcattttccatggattgctctccaagtttttgtgttcctggcctttggaaccccttcatcatattccgcaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281060 - DNA, 3665 bp, Homo sapiens
accttggtgtttcattattttacaaaataataattaagagaatataagagtggaatttctctagggaatgggttggaaaatatgtagttatatttttcatatcaagttataaatggattaaagtttggccattgtattcaaagtttggagctaaggcagtcttcggagggtagggctcctcgggattcatttctagtaatttaagatacattggcttgcaacaggattcctttgtgggtttcaatatgaattataataacatatttattagatggttattttgtttatacttttataggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281061 - DNA, 3061 bp, Homo sapiens
ctaagctaggtacgaggcgggtgtggaatcggccgagggtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281062 - DNA, 3213 bp, Homo sapiens
agagggcgggtcccccttttccaccacactggagagccaaattggaatatacccttatggaaaaaaaaaaaaaaaaaaaaaaaaaaacactcaactgggaatcaaaagtttcaaatcccaatggcaccactggaaagaatatacccttatacaagtcactttaatcttagaagggttttcctagaaagcgttttatgtaattcagtattacaggctatctgcttcctgtcataaccctgaatcacactgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281063 - DNA, 4030 bp, Homo sapiens
  misc_feature (3991)..(3991): n is a, c, g, or t
  misc_feature (3996)..(3996): n is a, c, g, or t
  misc_feature (4025)..(4025): n is a, c, g, or t
gaattccccgatgtacttctgcattaaattccttgctttcagaatcataaccagggaatcgtttggtactgtgagggatagacaagccctcatttctgtaatccctgctaagtgaggtcaaggctgacatctaagatgttctgtggcggaacctggcccccatcaggggcaacctttaatttggattctggaagactaaaactttgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggacaactgggaagaactttataacccgataccagggaggattcttaatatccagactaataaagctatcanttganggattgcagttgataaaatggctggagangttaa

SEQ ID NO: 281064 - DNA, 1778 bp, Homo sapiens
gggatttgcagttgataaaatggctggagaggttaaggctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281065 - DNA, 2123 bp, Homo sapiens
tggccaggtgcagtggctcacgcctgtaataccagcactttgggacgccgaggtgggcagatcacctgaggtcgggagttcgagactatcctggccaacatggtgaaatcctgtccctactaaaaatacaaaaattagctgagcgtggtggtgtgtgcctgtaatcccagctacttgggaggctgaggcaggagaatcgcttgaacctgggaggcagaggttgtggtgagccgagatgaggtcattgcactccagcctgggcaacaagtgtgaaactccgtctcaaaaaaaaaaaagtttccttaaatagttactggctttatttaaggacttctccatcgcccaacacacatcctttataacagactgaagttggcagagaacagaatgatttatttttagggtaaatggaagtttgttctcagcctcttggtttcacttactgtttaaaaccattgttttgcagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281066 - DNA, 1776 bp, Homo sapiens
  misc_feature (30)..(30): n is a, c, g, or t
tccccctactactattatattgggggcctncgacattataatgatttatttttagggtaaatggaagtttgttctcagcctcttggtttcacttactgtttaaaaccattgttttgcagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281067 - DNA, 1857 bp, Homo sapiens
aaattttgtaggttctgtctctttattaacttttgattaggttgttaagcatataattaaggggagaattcctatatgcaggtccaaggagttgcttgttttcttttagcctgagggtggcagtggtaaattctcatgcctgaagattatgcatccttcatatagaccagtgggtattttttcataacctgtaatattaacttcttattgctagtaatgatcctgcattctgggttgttttataccaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281068 - DNA, 1353 bp, Homo sapiens
gcacgagcaggaaccagttaactacattcattgtccaacccccactggtttgaaagaagactccaaattcttggcatatgatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281069 - DNA, 2229 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggaagatgacagattatcgaggtagtcccaaacagaagtacatggtggctgggcgggggccaacaggtggggcgaacaatggccccagagccgccacgggcccacatactacaacaactctcaatacataggcagagaggaccggcaacgacaggcccacagctaaaaactcatactacgatgcgcacacccgccagaagaatgacatcgggggaaacactgcaccaaacatggtccaaacccaggaacatacacgggggacgaaacgaccaacaaacctacaagcgaaccgacgtcagggagctcagcactcccgggaaccgcaaggcaacaaggcatccatggccccatgccacgggactacacatcagaacagacgccaggcccaacacccgcaagcaccactcatccccccctggcccccccatggcgcggcatgcggacgcatggaacttcaaccaggctcatggaacataggcccctgcccacagagaactacgacgactgcg

SEQ ID NO: 281070 - DNA, 1735 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacaggtaatctttaatagcttgagatagaaatggagagaaagtattgtcactctatccaggctgggacattttatttttgttctgaatacttaactcaaggtcaggatccatgtaataaataaattag

SEQ ID NO: 281071 - DNA, 1793 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttataggtatgttaatgatgtgttaccctgccttatcttttcaaatcactgatttcaaaagggcttccctcctaatcacagttgagtagcttctgctttacgatatggtgtaaatttttctaccttcccccacttccgtgcacatttcaagaatgcagatggacacccctccctttggtgctactgtctgagggtgtaagattttaaagtgagcatctggcggtagtagcatttttagatatattcttggctaagtttctcattgcagtagtttcatagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgcctttttagatgagctaagtgttggacagccggctcagtgctgtttttgggactatggaatgcatcttcctccaccactcccctcatttaatggaaggactttcttctctctccatctagcacagtaatcgctaatcccttagacaatgttttcccaaaatttcaggcagctattctatcaacaaactgataattaaacttgtgt

SEQ ID NO: 281072 - DNA, 192 bp, Homo sapiens
ttactggggaagaagctcatataatcatatgcagaacatccaagggagagttaactattcctatctttatcttttttcctgtagcttcataaacaagcagatatgcaagaagagaaaaaccgaatcgaaagagtccttggcgctactcttttgcctgacctgattcaaaaagtcctcacgtttgcactttca

SEQ ID NO: 281073 - DNA, 711 bp, Homo sapiens
tgttgtggtgtgcacctgtagtcccagctactcaggaggctgaggagggaagatcacctgagtctgggaggtcgaggctgcagtgagctgtgattatgccactgcactctagcctgggtgatgaagtaagaccgtatctcaaaaaataccagtttttatgatagaatttacttagttgcagaagaggggtggcaaggggaatgttaatttggctcactgtttcctgaacctgaaagaaccaaagaattagcagtgtagtgtcaaaagttaaataaaatttcttttttgtttaggaaaataaaaatataaacattttagattatcattgtttatcttctagaggatctctgggaaagtttagaaaatgctagtggtaaacctatagcagctgtgatgaatacctggaccaaacaaatgggatttcccctcatttatgtggaagctgaacagcaggtaaacatataaagtctttccatttgtctgatattgtattaaatgaagttcagtacagtgtatcaagtttgcttttctgtactttaagttttctagtgacatttaaaccagccctgttactcttttatcagtaattttacagcttgcatcattaaaattatacatgcttaagagagaaaacaaaatgttacttgcttgtctagtctccagggaaaatactgtaaaatttgatataattctaaaaccaccaaatatggt

SEQ ID NO: 281074 - DNA, 490 bp, Homo sapiens
gagttcatgtaccactaagaatgaactattgacttaacagtttggcttaggctcctggttagaacaccaccactcctctctccaccttaccttctgtttgtcccagtgcaaaatttgtttgttcttctctggcttaggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaaggtgagttcagaatcttacctaaacagatttctctcacttatacattttatggccggttttaaattctgcttcagtttagtagtttcaaagaaaaaaaaaaacctaaacttttctttgtgaaacttaggacgaattttcatatagtattgtccagacatttgtccttatgttagggaaggtagtggtagagaagcagatccaaaggcataggac

SEQ ID NO: 281075 - DNA, 411 bp, Homo sapiens
tttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttaaacacagggagactgcattgcttattgatccaaaaaattcctgttcttcatcccgccagtgggttgctctggttgtgggacatgaactcgcccatcaatggtttggaaatcttgttactatggtatttaatatttttaagtgctcaaatatatttatcttcatcctactccacattattttggctacatagtatttcaagtttggctgcaacactgtgcca

SEQ ID NO: 281076 - DNA, 517 bp, Homo sapiens
tagcacatatcaggcatttaagaataaatgtttgtttcctttcctgttcttattttcacatattggtagtttgagactaagttaataactttttaggcagtcaccctaaacatgactttcaagagttattttaggattagtctgccttttactttagtaagtactgtattctctccattgccaggaggaatatttgaaaaaggaaggaatgatttgaacattgtaaatagctaactgaatatagtgtcttgaggacatatttttggtaactgtgtttaacatctccataaaagtgttttttatttatcttcaatcacaggtacgggaaccttaaagatagattttgttggagagctgaatgacaaaatgaaaggtttctatagaagtaaatatactaccccttctggagaggtgcgctatgctgctgtaacacagtttgaggtatgggttattcttctctaaaatattattattcttaaattaggcattctgacaaagctgtgttttattatgtggg

SEQ ID NO: 281077 - DNA, 669 bp, Homo sapiens
aagatcacctgagtctgggaggtcgaggctgcagtgagctgtgattatgccactgcactctagcctgggtgatgaagtaagaccgtatctcaaaaaataccagtttttatgatagaatttacttagttgcagaagaggggtggcaaggggaatgttaatttggctcactgtttcctgaacctgaaagaaccaaagaattagcagtgtagtgtcaaaagttaaataaaatttcttttttgtttaggaaaataaaaatataaacattttagattatcattgtttatcttctagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaaggtgagttcagaatcttacctaaacagatttctctcacttatacattttatggccggttttaaat

SEQ ID NO: 281078 - DNA, 4299 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtga

SEQ ID NO: 281079 - DNA, 4234 bp, Homo sapiens
agcggacggaagagtcaaggctgggacctcatggcatcattttccatggattgctctccaagtttttgtgttcctggcctttggaaccccttcatcatattccgcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281080 - DNA, 3468 bp, Homo sapiens
agaagcgggaggagaaatcggctaggtcgaggctgggtgttaatcggccgaggcgtgttacactcctgtggcaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281081 - DNA, 3258 bp, Homo sapiens
  misc_feature (33)..(33): n is a, c, g, or t
cctgttcagcttccacataaatgaggggaaatnccatttgtttggtccaggtattcatcacagctgctataggtttaccactagcattttctaaactttcccagagatcctctgtggcagcattcttttgttggaacgaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281082 - DNA, 3344 bp, Homo sapiens
taatgctacttcaacatatttaattaggctcccatataattgtaattcattacaattagtgcaagaaatctaatgttcttcacctccatatcttcctcatcactcctctgcaactaccccaaaaataaacagaaccatagtggcttctttcccagcagaacaaagccaggactggaacccaggctctaagggatgacaggaatcatgttctattcaactttattattattagttactacatttttttgaggaccatcgttatacattatgagtgagttaaaggcagaaaaatgtaagttagaagggttttcctagaaagcgttttatgtaattcagtattacaggctatctgcttcctgtcataaccctgaatcacactgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281083 - DNA, 2154 bp, Homo sapiens
gtagtcttatgtctcttttacttctcaaatcaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaattagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttt

SEQ ID NO: 281084 - DNA, 3740 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaaaaaataacaccaaaaggcaaaaaaaaaaaactatacccggtcgtgaatttttaccctccctttgaagtttccaccccaaaacccaaattcccgtggggtcctttcttagcgactgacagcacactaattacggggaacaccattgtttcattagaccacatttaaatgtacgaaaaacaaagtgaattattaactatttaaattggttgtcctttttaacaagagtggatttatataaggaaccgcgtggaaaatttaactataggcgtgtaccgaacaaatgtgggacgataaaacaggggatttttaggcagagggccttcatgaaagggaggtataatctctgctaaacaaatgtggtcgtaaggatggctgtgaaaaagcccatgttttgtgaacctctttcagaaacagtttttaaacatgggattacccgggatacagta

SEQ ID NO: 281085 - DNA, 3186 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaaagtttccttaaatagttactggctttatttaaggacttctccatctcccatcacaca

SEQ ID NO: 281086 - DNA, 1575 bp, Homo sapiens
ctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatcaatctgtggagactcatatgtgatggttttggtctcagtttggacaatgggacttccttggtggagatttctgtcctttgtgaggcatcagaaattgtaccatctctgttttac

SEQ ID NO: 281087 - DNA, 4859 bp, Homo sapiens
gatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281088 - DNA, 1899 bp, Homo sapiens
  misc_feature (425)..(425): n is a, c, g, or t
  misc_feature (464)..(464): n is a, c, g, or t
  misc_feature (543)..(543): n is a, c, g, or t
atagaaagacaaccacaagataggagtttacaaagcccaggttctttctgatgagtgttgagattcatctacataatatctttattacttacagggaagggtgatgttattggggaagacgtgcaaatgccagtgaagacagagagatacagtaggcctgaaatggttagaaatagaagaatagaatgcacattcaaggccccgagagacgtggaaactggacactcgctggaggaggaagcaggctgggacgtgggagcgctgaaatgctttcagttgagccatgagcctgaaaaacacacgattcctttcccagagtagaaactatttttccctgattaaaatcgatgccgtgaaactgggctgaactctggctgccaggctttatgccacagggaattttgtgtcagagcgatctcaacctnttctgggaggtgatttctgaagtactgcaccaaaaatgntttcacttataacacaaatgcacagcatggaccacttaggagttaaggaacgaaccaggcacggtagcttacacttgtnatcccagcacttggggaggctgagacaggaggatcacttgaactctgaagacggaggtgggaggatctcttgaccccaggaggtcaaggctgcagtgagccaagattgtgccactgcactccagtctgggtgacagagtgagaccctgtctcaaaacaaaacaaacaaaggagttcagaaatgatctggcctttatattcctgcctgatcgtcagtgtattcaccaggacggaacactgactggaaatcaggtcctagctccactcctggctgggaaagagcatgaagtgttctaggaagaaaagtcctcctggaagacttggcaacagccaggagtcctgagtgaaccgctgtccttttgaatccctgagacgggctgcagggatgaggggctagaactgacaggaagacaggacagagagcagcacagcctcagaagtgcaggacagaggtgacccaggcaggcatgacgggctgtggctgcctgccctctgctctcacagcacccctgatcccactcactgtggtcccacgcagatgggttggggcctgtaaatgtcaggtgggaccagccagaggagctttgctgccagtactggcatgtcaggatgggggtctggtggtcagcacctcctctggccagtggtcttgtggggagaggcatccatgtggcctcctcctctgtcgggagggctgatgtgcagagaagtacggacttggagggcagctggatgagctggggcttgctcagggacacaggtctgtgtgttgtgccaaggctgaccccctcatcccacaccagaccctgcctctgactctgtgacctcagcacctgacttctgtctctcaggtcatctcccagtcagtaaaacatttgtgtgacgtgaggaggggcactgaagtgggtgatctttaaggccagatgtctctgtaaaagccttgactatcggaagcactgggctagggcagtgtagtacccagggggatgaggtgcatcagagcagcacctgctgaggccaagaacggaggtggctgctgccggcctccgggaggtccccttagggaagcatttcttcaggggtggcccagggacctccggcatcagggcctgcatggggattctgtgccagcccagccctgctaagtcccagccttgggaacctgaggagggtatctgcctatttttcttttaaacatgtttcttaggttattcactaaagtttgagaaccactgctttgtggctttgaaatgttcatttgaatttttctatgattactaagatttttgcccttaaggctctgtatataaacaacatactgtataaaataaactgggaatggcgtgaaaacagcatt

SEQ ID NO: 281089 - DNA, 1235 bp, Homo sapiens
  misc_feature (425)..(425): n is a, c, g, or t
  misc_feature (464)..(464): n is a, c, g, or t
  misc_feature (543)..(543): n is a, c, g, or t
atagaaagacaaccacaagataggagtttacaaagcccaggttctttctgatgagtgttgagattcatctacataatatctttattacttacagggaagggtgatgttattggggaagacgtgcaaatgccagtgaagacagagagatacagtaggcctgaaatggttagaaatagaagaatagaatgcacattcaaggccccgagagacgtggaaactggacactcgctggaggaggaagcaggctgggacgtgggagcgctgaaatgctttcagttgagccatgagcctgaaaaacacacgattcctttcccagagtagaaactatttttccctgattaaaatcgatgccgtgaaactgggctgaactctggctgccaggctttatgccacagggaattttgtgtcagagcgatctcaacctnttctgggaggtgatttctgaagtactgcaccaaaaatgntttcacttataacacaaatgcacagcatggaccacttaggagttaaggaacgaaccaggcacggtagcttacacttgtnatcccagcacttggggaggctgagacaggaggatcacttgaactctgaagacggaggtgggaggatctcttgaccccaggaggtcaaggctgcagtgagccaagattgtgccactgcactccagtctgggtgacagagtgagaccctgtctcaaaacaaaacaaacaaaggagttcagaaatgatctggcctttatattcctgcctgatcgtcagtgtattcaccaggacggaacactgactggaaatcaggtcctagctccactcctggctgggaaagagcatgaagtgttctaggaagaaaagtcctcctggaagacttggcaacagccaggagtcctgagtgaaccgctgtccttttgaatccctgagacgggctgcagggatgaggggctagaactgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281090 - DNA, 4890 bp, Homo sapiens
gatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281091 - DNA, 3506 bp, Homo sapiens
aggaaatggaaactttcaagctgaaattggtacattaaaaatactagtctatgcctgaagtccttggcagccaggggtggctccaagccagcagtgcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281092 - DNA, 2165 bp, Homo sapiens
gatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagttt

SEQ ID NO: 281093 - DNA, 365 bp, Homo sapiens
cagcagccacgcacatgctgagtgacatttcttccgcaatggccaatgggaactgggaagaagctaaggagctcgctcagtgtgcaaaaagggattggaacagactgaaaaaccacccttctctgaggtgagagtttttctaggtacctgccaaaatttatacattgaccaagttgttcccaacacttacagtaattttcttcatgaagaatatactcctttttctctgtggttaaaccagctgtggaattgaattttgtgcgtgctttgcctagaatggaagtgctgtgtgaaatagaaggaaatgtctgaaggtttaaagtgaatttgatataactcagatccctgggcaacacacatgccaa

SEQ ID NO: 281094 - DNA, 409 bp, Homo sapiens
ttgtaagtgaaggaccatccgtatatttgtgttacacttacaaatacagtgagagagcagaagagccatttaaatagttgtcagtgacaactacaacttacttgaatggcttttcattcagtaagatactaataacaacttttaaaaatttcttttccagctggtggaagttaaaggccccaatgatcgtctttcacataagcagatgatctggctggctgaactgcagaagctgggggctgaagtagaagtctgccatgtggttgcagttggagctaagagccaaagccttagctaaaaggtatggaattggggatatttggtcatacattaatgtaagattttcaagagtataaaacatgttttatttaattttgttatcgtgcattataaacctgatagtttgact

SEQ ID NO: 281095 - DNA, 4836 bp, Homo sapiens
ctgggaatgcctggaagcgccggcgcgcggagccaggtgggaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281096 - DNA, 3517 bp, Homo sapiens
catacgacgaggcgcacgatggcgcgcccaggaagaagaaattgtcgagacgaataacatgaggtcatatagaatcccacttttggtgatttcaagtcaagaaagtaaaactactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281097 - DNA, 3421 bp, Homo sapiens
gatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcattgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaa

SEQ ID NO: 281098 - DNA, 2876 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaataggattgttttaatccccattattctggaaagtgcatcctagtctcccagtctataacatcataataccttgaggtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgcctcactggtgggtgggaataaaatggaagtgcacagaggagatgtcagaagaccaaaacttggtgaatagtcccagtgctaggtcatataggaaacagaaagcatgacagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatccccactgcattgtaaaatttttgttgttttgtttcatgtcttattcacctttgtatggaaattaattcagaaaccccaagcatag

SEQ ID NO: 281099 - DNA, 549 bp, Homo sapiens
gcagagctgaaatgattagagatggaaatcattcaagccgaggaggccaggagaaaaataggagctattttcttgctgtgtggctcaaactcttaaacatgaagcttctgtgcatctttgggagggtgcgcgaggggtcatcagtttacgttgatactgtggaagtctcctattcaagtggcaggtcatagtttacagaaaaagattttgctcctgataccaaaggggcaatcaggcaatctaatcctcaccaatccctaattgattagctaattaaaaggactgagtttgaagtagagagcagacttggtgacaaagcagagacagaaagaagagggaggtcacaaggccaagtcgcagggccagcactgcagaactgagccagagtgcacagcaaccctcaggatggctctgcctaagggaactctgtgaaagtccactttttataccatcttttacccacctcttttcttaccccaaagttctgacaccaaagacagacagccagacaggcagctgcagaaagatgtacgttgtgtggataccacc

SEQ ID NO: 281100 - DNA, 479 bp, Homo sapiens
ggtccccatgtagtgcttgtactacgcagatgtttcctcttgagctattttaaaggtgtggaaaaagccaaagcaatgccctctccacggatactaaagactcacctttccactcagctgctgccaccgtctttctgggaaaacaactgcaaggtaagataccaacagctccctgtgacagaagggaaagtaagccaaccaaagcgagtcctgcagaccccaacgcagagcattcgtgatcacctttgcctctccactgtctctgatgcttaccagcaaagagaaaacataaagttctacattcagcaggacattcacctgaacagtttcaaataggacatgaaggcaggatccagattgaatgtttggagggaactagagacatggggaggcagtgagtgcagtaagcgtagctgtgaaatgaaggggagaagatggtggtcccaggctgcaggccatggggaggttttctaacagac

SEQ ID NO: 281101 - DNA, 2822 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaataggattgttttaatccccattattctggaaagtgcatcctagtctcccagtctataacatcataataccttgaggtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgcctcactggtgggtgggaataaaatggaagtgcacagaggagatgtcagaagaccagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatccccactgcattgtaaaatttttgttgttttgtttcatgtcttattcacctttgtatggaaattaattcagaaaccccaagcatag

SEQ ID NO: 281102 - DNA, 1291 bp, Homo sapiens
atgtgaataattgagacaaggtaggcagtgcttgaggattggcagtttgaaccactggagcaggctttcagccccagggagcttggactagtggtctggtatctgaccctgtgggtgtcagaggcaggtgaataatgacccagtgtgtacaagcccaacagtggaaatgctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 281103 - DNA, 1024 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgagacaggatttcaccatgttgcccaggctggtctcaaactcctgagctcaagcaatccacctgcctcaacctcccaaagtgccaagattacagacgtgagccactgcccctggtcttctttgcatattttaaacatagttatttatattctctattaggtacccaataactgaggtcactaggggtttagttcttccacctgttttttttctagctcttgttcatagggcttttccctcacttgttttgtaattttgtataaaaagctcttttctccctgtcttgatctcacac

SEQ ID NO: 281104 - DNA, 312 bp, Homo sapiens
ctgaagggggagttgggtgagtcaggtatgtggacaggccagattcagtatgggcactacaccactttactcagggacaccacatctttcaatcagagtgacactcctgtctggccttcctttttctaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccag

SEQ ID NO: 281105 - DNA, 1593 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 281106 - DNA, 1626 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgagacaggatttcaccatgttgcccaggctggtctcaaactcctgagctcaagcaatccacctgcctcaacctcccaaagtgccaagattacagacctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 281107 - DNA, 2480 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaataggattgttttaatccccattattctggaaagtgcatcctagtctcccagtctataacatcataataccttgaggtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgcctcactggtgggtgggaataaaatggaagtgcacagaggagatgtcagaagaccaaaacttggtgaatagtcccagtgctaggtcatataggaaacagaaagcatgacagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagctcttaagcgagctgggatactctagaatcaccggggca

SEQ ID NO: 281108 - DNA, 1247 bp, Homo sapiens
gcagagctgaaatgattagagatggaaatcattcaagccgaggaggccaggagaaaaataggagctattttcttgctgtgtggctcaaactcttaaacatgaagcttctgtgcatctttgggagggtgcgcgaggggtcatcagtttacgttgatactgtggaagtctcctattcaagtggcaggtcatagtttacagaaaaagattttgctcctgataccaaaggggcaatcaggcaatctaatcctcaccaatccctaattgattagctaattaaaaggactgagtttgaagtagagagcagacttggtgacaaagcagagacagaaagaagagggaggtcacaaggccaagtcgcagggccagcactgcagaactgagccagagtgcacagcaaccctcaggatggctctgcctaagggaactctgtgaaagtccactttttataccatcttttacccacctcttttcttaccccaaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 281109 - DNA, 3370 bp, Homo sapiens
aggtgggaaggcagttatgacagttgagaagtagtagaagacacggaaggcacagaaggcagacttcgctcagcacaaagaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcaggcttacacgtggtctctaacatacacagtgacgacggctgctgggtccccagctgagaactcccaacagctgccctgtatgaggaacactcacgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgttaactcatggggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttctgtttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 281110 - DNA, 2618 bp, Homo sapiens
  misc_feature (1782)..(1782): n is a, c, g, or t
  misc_feature (1788)..(1788): n is a, c, g, or t
  misc_feature (1833)..(1833): n is a, c, g, or t
  misc_feature (2546)..(2546): n is a, c, g, or t
  misc_feature (2606)..(2606): n is a, c, g, or t
gcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatccgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaagcaccggacggccattccacctgcagagcgcacatctatgggcctcgagacaggccacacccttggctctttatcctgagctctgtctgcaggcctggcagaagtctgtgcctagagggaatatggaagagctttatgacggccagggcccctctctcaggactcctgaaagagaggttgtccaaaagcccaagacgagttggctctgctgctttaaggaatctgattttgtaccaccctgcttttaggcatattttgtaaaatagtcttgggcatcattgaaaggattgccttgtggcctcttggaggatcaccaggttatctggactgttttgctgagcaaactctgctctgatagtatgcagtagaccagagaagcaaaactgtactattccctgcatgggagatggggcagaaaggtccagctgcaccatggtccatgagggttcacggcttcccattcatcagtttcatcaagcaaccaaccaactcatgctttatactttctgtgtgtcacatatgtggtgctaggtactgggaacacaggagcaaatcagttgctgccctcntggagnatagattccggtgggaaacagacaaaacagagaatcagattgtgncaaagttgtagcagagagcaacaaaagaggaatggccagggaaggtctttcagaggaggttacatttaagtaaagactaggggagtgcagaaggctgtgcagacacttgtctgctaggtgtgagtcagtgggaagggaatctcttcctgtactgctcgaccttcattaaaatctgcatttataggacttgcctctaaggatgtttcaaaaattgttggacgataataggtgttccatgaagaagagcagcaggccctataagtttggttaacactaagtttaaacagtttcctttactgcaagacttctcagaacccttattatgctaatgtacaaggtgactccactagagggtgccttattatgcagcatttctaagcattttgaccacgttgagcaggtcagcacatagtgacctataaaacactgtaactttttagaaaggcaaccatataggacttttaagacttgtcttgaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaatgagactaatttttttggtgtagctcagaagcttttgaaccagtctctaaaggnatttccagaagactgttgaacaaaggacctcttggaataaattcctaataattttccaanatgactattctg

SEQ ID NO: 281111 - DNA, 2004 bp, Homo sapiens
aggtgggaaggcagttatgacagttgagaagtagtagaagacacggaaggcacagaaggcagacttcgctcagcacaaagaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcaggcttacacgtggtctctaacatacacagtgacgacggctgctgggtccccagctgagaactcccaacagctgccctgtatgaggaacactcacgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacaggtgaagaaatggagactatgagcagcttaatgccttgctgatggttacagtttaagtggcagagctgggatctgaaaattactccaggcacagtggctcagacctacaatcacagcactttgggaggccaaggtggaaagatcacttgaggccaggagtttaagaccatggcaacatagtgagactctgtctctctctatatattaatttttaaaacacaataaaagaaatactactccaga

SEQ ID NO: 281112 - DNA, 1660 bp, Homo sapiens
atgcaacctcaagctaattttaactttgtggaatttctttcccctcaacaagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgttaactcatggggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttctgtttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 281113 - DNA, 2186 bp, Homo sapiens
tggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggtaatggaaagtccttcaaaaactttgggtagttaatgtttgaagaaagggctttctgccagcctgggcaacatagtgagacttcatttccacacacacaaaaagccagacatcttggctcacacctgtagtcccagctacttgggaggctgaggtgggagaattgcttgagcccaggagctacgatcgcaccactgcattctagccttagtgatacagtgagaccttgtctcaaaaaaggaaaaacagggctttctggaaaaacattcttctcccacaatctccaaaagataatgccaaaacctgggtatcttcctggatttgtgaatgacgtacaggtattcatttattcattggtacacattctgtatgctgctgttttcaagttggcaaattaagcatatgataaaatcccaaaact

SEQ ID NO: 281114 - DNA, 3352 bp, Homo sapiens
agcggggagaagccgttccgggcggaggcgagcagcagcgcgcggtccctacggtctgcgcgcggaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcaggcttacacgtggtctctaacatacacagtgacgacggctgctgggtccccagctgagaactcccaacagctgccctgtatgaggaacactcacgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgttaactcatggggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttctgtttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 281115 - DNA, 3306 bp, Homo sapiens
aggtgggaaggcagttatgacagttgagaagtagtagaagacacggaaggcacagaaggcagacttcgctcagcacaaagaagaattttctgataaccatactggcaaaatgaactgggctgccttcggagggtctgaattcttcatcccagaaggcattcagatagattcgagatgcccactaagcagaaatatcacggaatgaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcaggcttacacgtggtctctaacatacacagtgacgacggctgctgggtccccagctgagaactcccaacagctgccctgtatgaggaacactcacgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgttaactcatggggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttctgtttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 281116 - DNA, 803 bp, Homo sapiens
ggcacgagggtaggacgtgatgcaggaggcgcactcgaagatgtagacgatgagcatgagcaccagtgtccccatcccccaacccctggagtctcaccgtgaggaccatggaccggcggcggcagagtgcggcacccacaccaaaactggctaccatgaagaaggagaagccgcagaagatggcaatccaggcaccagcgaagacgtcatccttgcctgagactcccatcagtgggtatacacggtactggtcggctgtcacccatatggtctcagcaaacagggacaggcctgacagctggacagagcggtgggttaggaaggtctgctcggggccagcagccctggcaccaggcatctccacgagcaagttccctccccatttggagcctccactgccctctcagtaaagtgggcaaagacctcgccttccatgagcagcgatgagggtgagcagaggccaggagagaagagacagcccagccagacaaccgacccccacgccccagctgccagtttcttcggggataaaaggggatgccacgtggaaaggctggagcagtggactggcacagaggagatgcttggtccatctgccctcccttgacagtgctgttattccccgaggaggggaacatggccatggccataaacattacaaatgggccaggcaaggtggctcacacctgcagtcccagcattgtgggaggccgaggcgggaggattgcttgagcccaggagtttgagactagcctgggcaatagtgagaccccgtctctacaaaaaataaaaaaattagctag

SEQ ID NO: 281117 - DNA, 1101 bp, Homo sapiens
aacaaaatcagggcagggctacaggtgatctggtgaactggacttggtggatggtgtggaagggactttgggagagacctgtgcccatgataaaagggaagatgaagatgttcctttgagtttgcatgtgtggggcctttttggcatggttgacttgtctgtactccttcctgtgacttgacatcaaaattaggaacagcaagctctaccaaagcaaggtctcctctgcttcctcagactgccgaccagtgctgagaacagggacactgaatatctgtgagctgagcgcatccagccatcaactgactcactcactgaagaacgctacattctgggcatatcttccatgacagtccagcagggtagctgttggaaatccaaacatgtccactcctgcttacgacctcagtcaccacctcttcatatgattcttccatgggctgttcctgagcacctgagggagaaaaacaaacagaaacaaacaggaaagggcagaataattgatatgtgagaaggaaaaagtcaacagttgttgagacataagtgaatgctggagtacagtgactcaattatagcttgctgtgactttgaactcctggactcaacggatcctcccacttcagcctcccaaataactaggactacagcacctggttcttcttgacaactgcacattctgctacatgctgtgatgaccaggagaatcatttaaatttttatttggaggactcacttccaacttggaacacaagctgcaaaggaattccctaccagcatgccagcacatcatttggaagttcaaggtattcttgctcaacagctgcacacacattaaaagtccctggggtacatggcgcctgctgcctggggttggactctgtcgccggggattccagaaattagagtagaattcacagctctgcctctccacctgctgtgaggtcttcaagttacaactccgccgcctatcagggacctccgtgattagtaagggagaaattgtcatatttttctccctagatcacaggtctgaggaagcagtttccccaagattttgtaaaagtggctttataattaaaaacattgattttcctattagaa

SEQ ID NO: 281118 - DNA, 725 bp, Homo sapiens
aacaaaatcagggcagggctacaggtgatctggtgaactggacttggtggatggtgtggaagggactttgggagagacctgtgcccatgataaaagggaagatgaagatgttcctttgagtttgcatgtgtggggcctttttggcatggttgacttgtctgtactccttcctgtgacttgacatcaaaattagccttgcagcttcaggactgctgatcctgattatgctgtgcaaagggtgttcgttccacggtcacactgtctctatgaggcagcaacgtctaggagtgttatccccattgagggggcagataaaccaaggaaggaggagggcaggtgctggcccaagtcacacacagatgaaggcacacatggtcacgcatacctgggaaagcttagcagcactcctggctctcctcaggagttcatagaaccctgcgctgtgtggaccaccgagctcagaagggttgctgtgtgatgctcgaatcaggaggctctgatggactcttcccttctctgtctctccagcatctgactgaggcacgtttatgggactctggcgaggaagactccggtttgcagaacacctccaatggccactgcttaaattgaacaaatgatgcatcacaaaactacaacgggactcttcaaattcacggtcggcgcaatctgtatgtaattgtattgcaacaattgtccagcagatggcagtaaagtgtcatgaa

SEQ ID NO: 281119 - DNA, 553 bp, Homo sapiens
aagggactttgggagagacctgtgcccatgataaaagggaagatgaagatgttcctttgagtttgcatgtgtggggcctttttggcatggttgacttgtctgtactccttcctgtgacttgacatcaaaattaggtaagaaatcatgtatttattcatccttgttgacttttctagttttctgtggcattgattcttgaatggaagccctagcaatgaggaacttggcgtggaaaaggaggacagacatgcactgtctcaaccccctgtgtaaggagtagggtaatccaggccacctgctgcttggaattttcttcctgctcttttattgccctgaagggagttttgggtctgcctagagagtctggtagggttgagagtcaaactgtgcagctggtaagaagaatgggctgtaggcttgttaaaacacagtgtgctgtctctccctcccttttccgcaatctccgcagtttcggggtcagtaggtctgggataggccctgaggatttgcatttcctataagttcccaggtgatgctgatgtcctcaggaacc

SEQ ID NO: 281120 - DNA, 1084 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281121 - DNA, 1049 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaagtcgggttgccctcgccctctgggtcccagccttctggcggttggaaatggtactcactgtgcctgtggcccgggctcagtttcccgaaaatcctaggaaaaaaaaacgtttggggggagaccgttcttgatgcgataaaag

SEQ ID NO: 281122 - DNA, 799 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaataatcagaaaggaatttgaaaaaaaaaaaac

SEQ ID NO: 281123 - DNA, 441 bp, Homo sapiens
agtaatcttcaagagataaacacttaaactcacctggggctctcctaagaaggagtgaggatgctgatggggcattgatggggttgaaccatcctcggtgactcgtgcttagatgagagatttgcatccactggctttaaccagggccatgaagtggacagagctcagagtcctgtaatgcgaagcggaggtacccaggcaggctgatggccggcctcatgcttggccctccccacctttgcttctctccttcccgccactaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgagacctcgggtcctctggtcagcccgcg

SEQ ID NO: 281124 - DNA, 1737 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaaaaaaccaaaaaaaaaaaaaaaaaaaaaaaaacaaaaaacacaaaccacaaaaaacaaaaacaaaaaaataaaaaaaaaaactcaacaaaaacacagaacaacaacacactcaaccacacgaaacgaccacaaacaaaccccacgaccggctcggcgcccacccacccccacagaagcataccaacacagacacaaccggtgggcgcgcgccccacccacacgaactaacaccaccggcaccctcctgcctacaggacacgcgtctccgccgcagcacggggggaactcccaccacaaacaacaacggcccggcgcccgacggagcgcttcgcaccacccacagcgcgtgaggccaggatgctgtaaacacacggcgaggcagaggacatatcacaataaaacccccgcggggggggggaaccaaacacacacacacgacagacaagcacgaagacgaaaacgaacacatgcaagaaaccagacacgagacgaacgacaacacaagcaaaagcagcgccaacgcaacacacagcgaaatcagaacacacggatagagccaacaaagccacgatcaagcctcacgcagagctacacgacgcgccagcgagacacacacccaaccagcgcacaacgcgtgaccgcggccagtcacc

SEQ ID NO: 281125 - DNA, 976 bp, Homo sapiens
gtggacaaggcccatcacactcagggaccaacgccgaatgggctgggacacttttcttcagaagctggtcgccgccggctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281126 - DNA, 1090 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctctccactccttcattgggacggaagtgctggtccccgcctgccctctggtggacagtctgtgaaacaggccttcagttgggcggcgtgcaggttaccacaggggaggaaggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281127 - DNA, 1070 bp, Homo sapiens
tcaaagtcagacaggtagcctgtgatccaattattgccccccgggaaattttccgcgcacaattaaccgggtccgggggtcaacacaccggcactaccatttcgagggtgaagctcctcgacaccatggtggacacttttcttcagaagctggtcgccgccggcagctctccactccttcattgggacggaagtgctggtccccgcctgccctctggtggacagtctgtgaaacaggccttcagttgggcggcgtgcaggttaccacaggggaggaaggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281128 - DNA, 652 bp, Homo sapiens
gtcgagctgctcctccctctgtctgtcctgtgcacgaggcacaatcggagccacgcgaccaggacagcacgagctgaggccagccccacccggagcaggtgggaaacacatgggcgagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281129 - DNA, 754 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagtggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281130 - DNA, 1015 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctgcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccagggggcaatcagtggagattgaaaacagattctactagttctagattcgc

SEQ ID NO: 281131 - DNA, 594 bp, Homo sapiens
atgagctggggtgaaccaggctccctttcctttgcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaacaaagacacaaaaccaaatcaagactaaaaaaaaaaacaaaccgagcggagctttaataggggcgggggagaacaaaaaaacgaaatgaagagcgcccagagaccaaaaagtggatcggacacacacgcagtttttaaaaaggaaaaacggggggc

SEQ ID NO: 281132 - DNA, 500 bp, Homo sapiens
gagggatgggcattttgcacgggggctgatgccaccacgtcgggtgtctcagagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaacaaagacacaaaaccaaatcaagactaaaaaaaaaaacaaaccgagcggagctttaataggggcgggggagaacaaaaaaacgaaatgaagagcgcccagagaccaaaaagtggatcggacacacacgcagtttttaaaaaggaaaaacggggggc

SEQ ID NO: 281133 - DNA, 1418 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaaaaaactaacacgacaagacaccagtactcaaaaaaaaaaaaaaagggggggggcgcaaaaaaaaacacccaggagagggggccaaaggcttaagacgtaaccagcatttctgatagaaagggagacccacagagggagacgtgaaaaaaagcaaaagaaagggacgacgatataacacgggcgcgcacggggaaacacggcatacagggaactcgggaaaagacaccacaccgcgggggacacagcgggaaactcccagagaaatagcgcacggaaaaaaatcggggtaaggtaccccagaagtagtcgagaatgcccgcagtaacgaaatacg

SEQ ID NO: 281134 - DNA, 1021 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagctcatgcatgggcttgggcacttggggtggattaaccccttaattctctgttctactggatatctgggcagtctccttctagtaggatggccgcccctgtggccagcttccggcggtggaatgtaccgggccgggcacaggctacgctcacaagaaaatcaaggaaaaacggttgggaaagaggaccgctgaaggcagagagaaaagtcactgctcctgtattgt

SEQ ID NO: 281135 - DNA, 646 bp, Homo sapiens
gtggacaaggcccatcacactcagggaccaacgccgaatgggctgggacacttttcttcagaagctggtcgccgccggctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagtggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281136 - DNA, 1196 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctctccactccttcattgggacggaagtgctggtccccgcctgccctctggtggacagtctgtgaaacaggccttcagttgggcggcgtgcaggttaccacaggggaggaagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281137 - DNA, 1157 bp, Homo sapiens
agtaatcttcaagagataaacacttaaactcacctggggctctcctaagaaggagtgaggatgctgatggggcattgatggggttgaaccatcctcggtgactcgtgcttagatgagagatttgcatccactggctttaaccagggccatgaagtggacagagctcagagtcctgtaatgcgaagcggaggtacccaggcaggctgatggccggcctcatgcttggccctccccacctttgcttctctccttcccgccactaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281138 - DNA, 1182 bp, Homo sapiens
aaactattctgagaagctatcacgtttcggcgtcgcgcggaccacgatatgtaaggctgatctatggtcataggctgttatccgataggaagagtcactgaggtgcgagttgcagctcatgttgcgtatagtcattgttcgtccaccacagtacaacataaccgctctctgcgaggggatgcacgacgtcgctcctagcaacaatagtctcgaggaactgcgtatgtttcctttgcagggatcgactttgagctcggactctagtcaagcatgagcgtcacaattcgacggtcgtagtattctaaagttgactgcctcacgcagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 281139 - DNA, 1146 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaacaaagacacaaaaccaaatcaagactaaaaaaaaaaacaaaccgagcggagctttaataggggcgggggagaacaaaaaaacgaaatgaagagcgcccagagaccaaaaagtggatcggacacacacgcagtttttaaaaaggaaaaacggggggc

SEQ ID NO: 281140 - DNA, 639 bp, Homo sapiens
cgcagccaccgagacaccatgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaacaaagacacaaaaccaaatcaagactaaaaaaaaaaacaaaccgagcggagctttaataggggcgggggagaacaaaaaaacgaaatgaagagcgcccagagaccaaaaagtggatcggacacacacgcagtttttaaaaaggaaaaacggggggc

SEQ ID NO: 281141 - DNA, 1121 bp, Homo sapiens
ttcggacgcgtgggtcagcttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagacggagtttcactcttgttgcccagactggagtgcagtggcgtgatctcggctcatggcaacctccacctcctgggttcaagaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaacaaagacacaaaaccaaatcaagactaaaaaaaaaaacaaaccgagcggagctttaataggggcgggggagaacaaaaaaacgaaatgaagagcgcccagagaccaaaaagtggatcggacacacacgcagtttttaaaaaggaaaaacggggggc

SEQ ID NO: 281142 - DNA, 447 bp, Homo sapiens
tgtgggcttggaagctgaaccttcttccacaagggccttccgcctccttcattccttgtgccccgtgtggccctccaggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtcagtgtcccagcctgcctcttcctcttccttctctaatgggccctctgagatccgcaaattggtggcttcctccattccaacacaggggacccccacagggggtaggagagcttgccccctggggaacagtcatgaattacctctccttgggcgtgtgcagtagcctctgc

SEQ ID NO: 281143 - DNA, 735 bp, Homo sapiens
  misc_feature (378)..(378): n is a, c, g, or t
  misc_feature (381)..(382): n is a, c, g, or t
acaggacgaacattcttgagttccaaacttgcctcttccatctactgactacttagaccaggtagtataatatgtcgagctcactttccttaagtggaaaaagaagacaatattatctagtttctaggattactagaaggatttataaataacacataaaaagtgtttatataccaggcttatataaataaaagatattgtcataatttatctaattacttcccctaaaacctaacttaatagtgcttataaactacttttaatttgttgatggaaaactaagtgttaagtgcttcttagctacacacaatgaatgcaattttcagtccagttgccaaatatggtttattaggaagagaaccccctgggagaaggaanccnngaagaattgatgaggtcaacacagctagggcatgattacctgttataaggtgtagaaaacgttgccaggacaacatcacgcccgttgatacgaatcacatctgtaactgcctggagaatgttgaaataaaaatgagagtctccaggaactgagcagttcaagcgcgccttcaggaacgacgtccactgtttctccaggactctttgagatcctcccatatcattcttacaaacctgagccactcttgggaaaactacctgcagaggaaaaacacatagggaaaattaaatgcattcattttgcaaggagatcttagtagaatctgcattccttgaaaacagaaacaaaacaac

SEQ ID NO: 281144 - DNA, 482 bp, Homo sapiens
agggtaaatgttcaagaaactcttctccaaatccaaattccacttggattccacttcgggaggaaagtccatgtgaagacacagtgagaaggcaagaaggcatccatctgcaagtcaggaaaagagccctcatcagaaaccaaatgttgtgagaacttgatcttggacttcccagcctccagaactgtgagaaaattaatttatgttgtctaagccacacagtctgtagtatactgttatggcagcctgagcagattatgacagatgtcaaagagaacttcagccttagctgatatgttagctgtaatcttttaatgttttagaatgagagtgtatgtatgtattactcatgtgactaaaacattaactttttaaagtcaactttgtcttccctcttgccccataaccatgcttttcccctttatcttcctttgaacaatattaattaaggcctgttgcagacatatgcattctgagccttc

SEQ ID NO: 281145 - DNA, 758 bp, Homo sapiens
gaaaacgggaatcccgaagaaatggtgggtcctggccatccgtgagatcttcccagggcagctcccctctgtggaacccaatctgtcttccatcctgtgtggccgagggccaggcttctcactaggcctctgcaggaggctgccatttgtcctgcccaccttcttagaagcgagacggagcagacccatctgctactgccctttctataataactaaagttagctgccctggactattcaccccctagtctcaatttaaaaagatccccatggccacagggcccctgcctgggggcttgtcacctcccccaccttcttcctgagtcactcctgcagccttgctccctaacctgccccacagccttgcctggatgtctatctccctggcttggtgccagttcctccaagtcgatggcacctccctccctctcaaccacttgagcaaactccaagacatcttctaccccaacaccagcaattgtgccaagggccattaggctctcagcatgactatttttagagaccccgtgtctgtcactgaaaccttttttgtgggagactattcctcccatctgcaacagctgcccctgctaactgcccttctctcctccctctcatcccagagaaacaggtcagctgggagcttctgcccccactgcctagggaccaacaggggcaggaggcagtcactgaccccgagacgtttgcatcctgcacagctagaggtcctttattaaaagcacactgttggtttctgc

SEQ ID NO: 281146 - DNA, 494 bp, Homo sapiens
gataaacagtggctttggagcagaccagtggagaaggtccagaagtggaaatggagtcctggcagaagcgatacgattcgctccaaaagattgtggagaagcagcagcagaagatggatcagttgcgctcacaagtacaggtgagcaggaatccttgggacatggtgggcagaacttaatgatggaatctctagaatttagccaatatttattttgttctctgccatgcaggttgctcagtgttagggatacaaaaagaatgagacccagtcagtgcttttgagccttgctgagaggacacaaatatagtagggagtttcagcacagtactgtgagagcagtccccacagtatcctgggggagtgcaggagagtcagtgggaggaagggaggtaaaagagaggtttctggagatcctgaacctacaaggatgaggagttagccaggcaaacaagaggagcctgttagggctccaaagcctgttagggggtaccg

SEQ ID NO: 281147 - DNA, 557 bp, Homo sapiens
tttagaatataaaatatatataaatgtggtaaaaattattaaaataattattttattttgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgcctgtttcttagattacaatagtgtactgtgcttatttgttctaagagaagaattgcttctttatacagctccgacagaagcaggagtccgagttaaaccttcagttgtatagacaataaactataattttcatatgcaattcaaaaaaaaatg

SEQ ID NO: 281148 - DNA, 449 bp, Homo sapiens
gtattgcctgtttcaaatgtgacagtgtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgacctccctggttgcgcctgcccggagggaaggattattctgagttgtctgtaacctggtagggcgatgtctaaagaaatcagaatccagctctgaaaaaaa

SEQ ID NO: 281149 - DNA, 1324 bp, Homo sapiens
aggagtttctgtggagccagccaccctcaccaggtgccttccattagagtttaatgctttgctgcggtttcctgaaagagccccacagagagtgggtctcgatgggtcctgaaccgcaccacaaccggccagtgagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgcctgtttcttagattacaatagtgtactgtgcttatttgttctaagagaagaattgcttctttatacagctccgacagaagcaggagtccgagttaaaccttcagttgtatagacaataaactataattttcatatgcaattcaaaaaaaaatg

SEQ ID NO: 281150 - DNA, 1443 bp, Homo sapiens
gcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcggcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggctgggctcctccgtaggttctcctgccaacaagcgagacagaaaggaggcggcagctgggggaactcagccttccttcccaccacacctgcaccttgctgagccactgctcccaagacgaggcacagaattcccagagcagcctggcttcaacctactcatttggtgttctttaaattaaaaaaa

SEQ ID NO: 281151 - DNA, 677 bp, Homo sapiens
ctcccacccccccccccatccccccccccacatctttccctttcctcccccttttacttcgggtaaaactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgcctgtttcttagattacaatagtgtactgtgcttatttgttctaagagaagaattgcttctttatacagctccgacagaagcaggagtccgagttaaaccttcagttgtatagacaataaactataattttcatatgcaattcaaaaaaaaatg

SEQ ID NO: 281152 - DNA, 559 bp, Homo sapiens
ctagactgtgtaggacttttcgggaaattgcagagaagtaactggcctctttgtgtgtttgcatgcaccatgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgcctgtttcttagattacaatagtgtactgtgcttatttgttctaagagaagaattgcttctttatacagctccgacagaagcaggagtccgagttaaaccttcagttgtatagacaataaactataattttcatatgcaattca

SEQ ID NO: 281153 - DNA, 991 bp, Homo sapiens
gcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcggcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtaagtcagggcacagctgtgccggccagctgcacccgctgaagtgacatctccca

SEQ ID NO: 281154 - DNA, 1756 bp, Homo sapiens
gcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcggcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgcctgtttcttagattacaatagtgtactgtgcttatttgttctaagagaagaattgcttctttatacagctccgacagaagcaggagtccgagttaaaccttcagttgtatagacaataaactataattttcatatgcaattcaaaaaaaaatg

SEQ ID NO: 281155 - DNA, 1486 bp, Homo sapiens
gcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcggcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtaacccatcgacaaagaagtgaattgtcctccatgttagcgaagtggggaggtccagacttgctccttgtctttctaccattttctaccatcattgtatgtaaaagtctaatcttcattttaagtcagtttatgcttcccagactaaactctgcaacaaataatatgaatgtcacacatttcatcatttgtaattaattccaaactaaataaaacaaggagttgtgaaa

SEQ ID NO: 281156 - DNA, 1625 bp, Homo sapiens
gcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcggcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaagattctaggaatgaaaaattacaaaaccacatcaccttggcccttaagtaacagatgaaaactactgacagacggcagcgaatcatgtcttccaatgaatagcagaataatgctggaaattggaaaaattcaatgtcaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtaacccatcgacaaagaagtgaattgtcctccatgttagcgaagtggggaggtccagacttgctccttgtctttctaccattttctaccatcattgtatgtaaaagtctaatcttcattttaagtcagtttatgcttcccagactaaactctgcaacaaataatatgaatgtcacacatttcatcatttgtaattaattccaaactaaataaaacaaggagttgtgaaa

SEQ ID NO: 281157 - DNA, 1127 bp, Homo sapiens
atctaaaggacacggcggagcagagagagatgctcggccgctcctcctcctccgggtccaggacttgcttcttatttgctggacgctgatctccctgcagccctcggaggcggcggccgcgctgctttcatttcggggctgtcatcaccagaaacgccggctgccggccgcccaccagctcggctccagccaggcggtggtctctacaaggatgtctgacctagagtggagatggggtgactgaggatggaaatctagtctgaactccactctccaatttggcagaagacctgtgtcttactcagctttgtgttccttacatctctgtagcacacactcccctgcgaaggggttttataaggaacccagagccaagacaaaggaatcaggaggaattctagcacaatgggaagcccctgaagggtttaagcagaagacaataaaagactccgagaagtggcagcagggagtggaggaaaaaaagcctggaatttaccctgctttctgctctgcacatggaatgccccctccatgtgtccattgtcatccaaggtgttttgacaggtctagagtggggtaaaagaatggtatttattcaggcctaatattgaggcttggggctgggctgtatatcagagggcatgcatagacaaagctgaacaaaggggcacacctactgggcacctgctgggcacttctctaaaagtggcactgagacatcattaggatgaattagaactagggcaccagttaacccgggcctgcatgctagtgaaaggaaaattgcgcctctccctcaaccctgctccagacaactgaatggtgacttcaagaacaaatattcaggctgggtgcggtggctcacacctgtaatcccaacacttttggaggctgaggtgagtggatcacctgaggtcaggagttcgagactagcctggccaacatggtgaaaccctgtttctactaaagatacaaaaattagctgggcgtggtggtgggtgccagtaatctcagctaggaggctgaggcaggagaatcgcttgagcctgggaggcagaggttgttgagatggtgccattgcacttcagcctggacgacaagagcataactctgtctcaaaaaaaaaa

SEQ ID NO: 281158 - DNA, 1228 bp, Homo sapiens
aggcaagagtgaggaggacagctgggagagctgtttgtgactgaagagcagagagtacagacagaactacacagttctcaaattccatacaaaattttaatacgtttttcacttcacagattctgaacctgccacaggaccagctcctttggtgagcgaagtgtgtgagcgaaggaaagattcttgggtagaacttcataaagtctgtcataagatcagccccagaggaggagacttttcagatcccatccctcatacacattcagaaggccaaggaaacaccctcaggattgaactatgataaagaaggcttttggacttggacctcatccaaggagctggctgcctgcactttcacagaccgtcagcttcatccccaggccccaaatcctgaatttgccgtgtcaatgaaaaaccatcatcagcttttctttacattaaaaactgattgtgatcatagcagtttttcctgttttctgggatcactgctgcgaagaggaaaagtcaccagaggataaaatgacacacacgcaaactcttctgtggctgaaattcccctcactcttcctgcctctaaccgaaaaggaggatacagaccaaggagcacttcatgaaggaaaaccaaggcccaagtcatacagctagtaaaaggaggagccacaattcaaaccaggactgatttcaaaattcgcattccttccactatgccatggaaagtacagtagggtgtttttatgtcaactgcagccagacacatcaattttctcctctgagaggacaggatataaatctgaagaaacaatgtatatgaaaatatgctctatgctataaggcaagatttatatgtaagtcagacatagcagcaccaagagacaaaacagacagtgttcactaggacgaacaagcggctcaaaaggcactggagtttccctgtaagaactacaaacaccacgggagtgatgttaactcagatttttccatataaaagattcttcctgtaaaaatatcctgtgcctttgtgctaaataaaagtaaaatgatgctttttagagtgaagtctaaacacctcagattcagcaagagtgagatcagctagatttgcaaagtcaagaaaattggctgtttccctcctccttaagctaatagaatccaactgttggagcatgacatcattcctgagccccaaaccccgagcagagactacagacactcgcctgactcccagaaa

SEQ ID NO: 281159 - DNA, 995 bp, Homo sapiens
aggcaagagtgaggaggacagctgggagagctgtttgtgactgaagagcagagagtacagacagaactacacagttctcaaattccatacaaaattttaatacgtttttcacttcacagattctgaacctgccacaggaccagctcctttggtgagcgaagtgtgtgagcgaaggaaagattcttgggtagaacttcataaagtctgtcataagatcagccccagaggaggagacttttcagatcccatccctcatacacattcagaaggccaaggaaacaccctcaggattgaactatgataaagaaggcttttggacttggacctcatccaaggagctggctgcctgcactttcacagaccgtcagcttcatccccaggccccaaatcctgaatttgccgtgtcaatgaaaaaccatcatcagcttttctttacattaaaaactgattgtgatcatagcagtttttcctgttttctgggatcactgctgcgaagaggaaaagtcaccagaggataaaatgacacacacgcaaactcttctgtggctgaaattcccctcactcttcctgcctctaaccgaaaaggaggatacagaccaaggagcacttcatgaaggtcagacatagcagcaccaagagacaaaacagacagtgttcactaggacgaacaagcggctcaaaaggcactggagtttccctgtaagaactacaaacaccacgggagtgatgttaactcagatttttccatataaaagattcttcctgtaaaaatatcctgtgcctttgtgctaaataaaagtaaaatgatgctttttagagtgaagtctaaacacctcagattcagcaagagtgagatcagctagatttgcaaagtcaagaaaattggctgtttccctcctccttaagctaatagaatccaactgttggagcatgacatcattcctgagccccaaaccccgagcagagactacagacactcgcctgactcccagaaa

SEQ ID NO: 281160 - DNA, 336 bp, Homo sapiens
cggccgcgcggatcaccgtggttcttgcggctcccgggcgtggccatttacaacccgcctcgcacctgctagagaaaagaccccggccatggatgggagacctaggacaaagatggaaaagagaatcaactctgccttaggcgaacaatttaccataatattctgagacaggagtggaataacacctccagccattacctgcaaatgagagctgctttaggcgggcatttgatcgagcttcctggactttatctgtcaatgacttccaggcatctgaaaggaaataaagaaaacccgtaagccagaaaatatgcacgtaaacccttcttaatacca

SEQ ID NO: 281161 - DNA, 524 bp, Homo sapiens
cggccgcgcggatcaccgtggttcttgcggctcccgggcgtggccatttacaacccgcctcgcacctgctagaggtccaatccaacaatgtctccaaatggggtgtcagggttgaagatggcctgcagcactgcctgatcatttggagtccccatggtgctcaactccaaaatcccaaaagaaaagaccccggccatggatgggagacctaggacaaagatggaaaagagtgcttggcaccagacagctgctcaatgaggaacacaactgcatcatggagaatccccagcatcctcaaaccgttaacacctagaagaatcagaagcaccagggaagtgaggagcgcagtcaacaggaaacagcatggtcctacagaaatgcctatgctatagtcactctgccagaggctgctccagggtgaattatagtacatattagctcgaaattagcatcagatagccattaaaatgatgctgatacagatctatcaatatggaaaatgtttgtgatagacggctaagtga

SEQ ID NO: 281162 - DNA, 547 bp, Homo sapiens
cgggaggccagcaggccagcctatgtgcagagctacactccagatcaaatgcccaccttcttctcgttcttccttttctgcttcctctccgaggtccaatccaacaatgtctccaaatggggtgtcagggttgaagatggcctgcagcactgcctgatcatttggagtccccatggtgctcaactccaaaatcccaaaaggtgactccagatgagagaagagggagggacgtggtgagggtggagcctccagcaggaagttgatctgaaaggatgaggaccaccccttcgtgaggagtgtctccctgtccatggctgtagcatttgctcaacctgtggcctggagggttgaccctggcttggcagactacttggttatttctcaactgcccctgcccccaggagaaacagtaaacaaatccagcttcagccttaaggtggagtgcagctagagaaggtgttctccagcttctccctgaaatgctttcagtttattatattcacagttgagaaaaccgataaaaatcaatacttaacctccttggatg

SEQ ID NO: 281163 - DNA, 417 bp, Homo sapiens
cggccgcgcggatcaccgtggttcttgcggctcccgggcgtggccatttacaacccgcctcgcacctgctagagaaaagaccccggccatggatgggagacctaggacaaagatggaaaagagtgcttggcaccagacagctgctcaatgaggaacacaactgcatcatggagaatccccagcatcctcaaaccgttaacacctagaagaatcagaagcaccagggaagtgaggagcgcagtcaacaggaaacagcatggtcctacagaaatgcctatgctatagtcactctgccagaggctgctccagggtgaattatagtacatattagctcgaaattagcatcagatagccattaaaatgatgctgatacagatctatcaatatggaaaatgtttgtgatagacggctaagtga

SEQ ID NO: 281164 - DNA, 447 bp, Homo sapiens
gcggccgcggctcaccaccccccggctggtccccagcccgcgccgagtacccccgagtgcccttctctccgggcgcgggcaggacgcaggagcaggcggagtcgaaaagaccccggccatggatgggagacctaggacaaagatggaaaagagtgcttggcaccagacagctgctcaatgaggaacacaactgcatcatggagaatccccagcatcctcaaaccgttaacacctagaagaatcagaagcaccagggaagtgaggagcgcagtcaacaggaaacagcatggtcctacagaaatgcctatgctatagtcactctgccagaggctgctccagggtgaattatagtacatattagctcgaaattagcatcagatagccattaaaatgatgctgatacagatctatcaatatggaaaatgtttgtgatagacggctaagtga

SEQ ID NO: 281165 - DNA, 239 bp, Homo sapiens
agctgctcagagcattcaactggtttacaatttctgtaaacagaagccagtcaagacaaatataagaaaaatgcaagataatgaaaactgaagagcggcagatacaacttttttagataatggcttgaattttaacttgacatcagtctgagttggcatagggcttgcatactgtttcatattgatgctgctagtagcaagagctttccttcgaccagaaggggattcctggaagatta

SEQ ID NO: 281166 - DNA, 711 bp, Homo sapiens
ccgagagcagagtccatgaggagggctgtttggggctggtcaggcacgaaggctggtctgtgacaggccttccaggcctaaaggcaatgagagccaccttgtgactcacatgtggtcagcctctcctggcattctacggaattcaacaatttatctggatcgaatccccgggaaatatgtagaatgacatttacaagctgggcctctcctcgctcagctcccactgccgcgcagcccactcgtgggcatctgagtttgggcagagtcggcctcaccttgtcagccaggtcccagatccgggctgtgccatcgttgctggcagagatgaagaggtccttggaaggctacctcaggtgagagcttcagcacagactcctccatcacccagcctctgccagaatattccagtgactgcagagcaaagcagccaattctcctgttcttggacagctcaagctcttagttacctgtggagaggttctgaacgatgccagccgctgctgtgtggaagatgatgtcagcgccatcattaagcatatgtttacagctgtattgcttcaaaactgaagatgagaggagcaaggggaagaaacctgcattgtggcaaattcagcggattttaagtattgacccttcgcggttgtggattctgcgtgaacacttagtactggatgttcaccaaacacctgtgtttgtctccagagcggtgtg

SEQ ID NO: 281167 - DNA, 1243 bp, Homo sapiens
atggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataaataaataatgaatgaatgaa

SEQ ID NO: 281168 - DNA, 516 bp, Homo sapiens
gcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggcagacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacaggtgagcgcgccctgctgctggcctccgggtctcaagtcgcctgtcagtcagggccttcccctgccacccgccctccc

SEQ ID NO: 281169 - DNA, 521 bp, Homo sapiens
gcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggcagacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacagggcgaacgctgttggagaagctgttcagccagcaggagaacgggcctccagaagaagcagagaagttttgctcccggatcat

SEQ ID NO: 281170 - DNA, 2748 bp, Homo sapiens
cggcttctcactctgttgcccaagctggagtgcagtggcacaatctcaactcactacaatctccgcctcccaggttcaagcaattctcgtgccttggcttcctgagtagctgggattacaggcacgtgctaccacacccagccaatttttgtatttttagtagagatggggcttcatcatgctggccaggccggtctcaaactcctggtctcaagtgatctgcctgcctcggcctcccaaagtgctgggattacagatgtgagccactacacccagcccttctcttcatttttaaagtctctattactatctttgaattcactaattttttcttctgcagtgtctaatctgctgttaatcccagccaatatatttttcatctaaaacactgtattcttcatcactagaagtttgatttgggtcttttttataccttccatatctcttcttaccattctcatgttctctaacatcctgaacatacagagtacatttataattgttgtcctaacatctttgtctactaattcttttttttcttttttgataagagtctcgctctgtcacccaggctgtagtgaaatggcacgatctcagctcgctgcaacctttacctcctgggttcaagtcattcttgtacctcagcctcccaagtagctgggattacaggcgtgtgccaccaggcctggctaatttttgtgtttttagtagagatgggtttcgccatgttggctgtgctgatctcgaactcctgggctcaagtgatctgcccacctgagcctcccaaagtgctagcattacaggcaggagctaccgcacccaaccctttgtctattaattctaccaactgggttatttctgggtatgtttccattctgtgatttttctccattttatgggtcatattttcctttgcatccctggtaatttctgccagggactatgaattttgctttgccagacattgtgaattttgctttgttttgggggctggattttttctttttttttttttttgtattccctcaaatatttaagggtttgttctgaaatatacttcattaacttggaaatagtttaatctcttcaaaatttgcttttaaactttggtaggctggtctagaacagctgttagtctagatttttcttttcttttcttttctttttgcctctggttccagttcttgtgatagaattaatttgatcccattactgtggactctattcaatgcctgtcatgttaagaggtatttccatacagactggtgagaacatgaatgttctctgtgtgagctctggaaactgttctgtctgctgctttccagtgattttttccctgacttccagtagtctcctcacacaaaagggctgatcaacgctcagctgctgactcatgagcaagtctatgcagctccccagagagttctctctgtgcagatctttcctctccagtactctgacctgcaaaattatcgccatctcagcctccttgaaagatgaactttgtttcttcaactcaacaacatctccagcctctgtgtgcagcctggaaattccatccaggcagtaaggtggagtgctcttagggcccatctcatttgtttcctttctttcagggatcattatcagcaaggcttgctgtccaacgtctgaaaaccactgttttatatattttgtctgctttttttgacaggagggtaaatctagtccctgttacagctttttggctggaggcagaaatcttgtttgtgatttttaagaattactctcttaaatttaattttgttttataattatgtaaaatacaaagctctgaagttaaaacaaggtacagtaatattctatataacattttggtcagtgatgaaccacatatatgacagtggtcccataaaataatacattttagttgtaccttttctgtgtttagttaaacaaacactaggtgttacattacaactgcctacattattcagtacacaatatgctgtacaggtgtgcagcctaggagcaataggctatactatataactgcgatgttagtaggctacactatctaggtttgtgtaagtgcactctgtgatgtttgcacaatgatggtatcacctaatgacgcatttctcagaatgtatccctatcattaagtgatgcattcagaaaagtctagggtctaaccctttgcttttccctacacactcactgaggtaaacattaaaaaaaaaaatttccccctccaccccttttaagtttttattatttccatactattgtttttattattaacataaacaagtatatacatccacttacatctctactttcttcttaggtgattagcagcatactacaaaattctctcaaactactgttttacttagtaatttatcctgaagatcactccatacaagtatatagagatagtcttcattgcctatcttttgaatttataacttaaaagaaggaattaaaaatgtaaaaacattatcactgatattttcaaggtctttacttacgccatgctgaaagagggttttgcatcctggtcagataaagaagcaatggtgtgctgaggaaatccttcatagaagaaaatgtattactttctttttccaagcaaacagcaaaattctaggactaagaacctaaaaatgttcttctcaaaaagccaatgaagttgtacaaaatatcactttactgcctttcagataagcttattatagcatgatgaaactgactaattccaagcta

SEQ ID NO: 281171 - DNA, 908 bp, Homo sapiens
tctgaaattgtggcaataatcaatagtttaccaaccaaaaagagtccaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttcagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgcacgacagcccaaacggtacgagctcgatcta

SEQ ID NO: 281172 - DNA, 819 bp, Homo sapiens
taaagccaaaggaaatactcagtttatgtgttaaatacaattcctgactaggatatgagagttggttaaaaaaacattatattatggaatggaaaaacaaatttacaatttaatacttccctgtgggttaggagactctttttcttacttgttacttatacgatataatatggcaacccagtttaatatcataccatggataatactaacagatgaattctaaaagttgtttcatgacagttaatggctgataaattaaaattgatttggcagtacattgcatttaaacagttaaaaatgaaacaattttctgcttgtattcactttcacagttattttattttattttcagagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttcagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgcacgacagcccaaacggtacgagctcgatcta

SEQ ID NO: 281173 - DNA, 1123 bp, Homo sapiens
cggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttcagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgcacgacagcccaaacggtacgagctcgatcta

SEQ ID NO: 281174 - DNA, 958 bp, Homo sapiens
ctctagagatcccgtattgtctacacaaagatgcgcttccccttaccagagagccagaaagaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttcagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgcacgacagcccaaacggtacgagctcgatcta

SEQ ID NO: 281175 - DNA, 543 bp, Homo sapiens
aaaacaggagtttccctggacaagttcttctcttgttgccaccgtgtgagatgtgcctttcaccttctgccatgattgtgaggccttcccagccacgtggaactactatttatttaaaaatacacaagaaactgttgactatcacccatggagggaaggctgaagaaccgagggtctggtgtagaagagagagttcctgaaaatgaacatttttgtccatccctgctgcaccacttcttcaagtataagatatatactcacttgtccagggacatcccagggaaggtgaacttgcccaggcagatgcgatagacagcgctcagaggaatccgctgcagctgcacacaactcagcatgatgaagtcgtatttgcagatcaagagagtcttgtctgtgaccagtagaattctctccttctcattgttccagtggtctatcctataggaatcatcatagcaaataaaaattgatgacacagcctaagttaaaagcaatgaccttcacatctctcctagcacagaaaacagtgaagtttgatcaact

SEQ ID NO: 281176 - DNA, 1195 bp, Homo sapiens
gagagacaaggaaatgctgtcaccgcggttaacacgcacgtggaggtggttaaagggaagacctgggttttagtcctgtctccatcaacctcaagaaatgggacctcatggaagggaggggaggcaatgccgaggatgtgctcctgagcaggtgccacaattcttcacctgtaaggctgatctaagaagattcctaattatcaattgagagcagagatattccacttccaattacatggcctgcctgctcactcttacttcctattcacactctcttggagaccactttgtgattctaccaaattctataggagaggtgacaaccccaaagagaaggctctagaaagatgacatttggaaatgtgtacgctagtgtctgctggctcctcctgagccatttttactctgtgaatgagatcaaaggccacctaactgcctaaatcaccacaaagggacaaactggtatctcagagcactcagcaacaaaaacaagaaagctaagcctctgcactgcaatgtggcagggcttctggctaagtatagcaagcaattctgatgtggagacaaacagcagcaatgggaatgatatgccaatgaaggattccaacagttgggtctgcaagtgtgcttgtcctgtgacacaaacggcctagacatctcagcactgcttggagctgctcattgggggagcctaagaaacatcagccctttcacaacctcttgctcctgagcagagctcatctcccaagagcacatcagcccgcagcccagtctgatgagaagcacagtattcccctgtgccagtggcagcctcagagcatcctgaaagagcgcttcctagacacgcagtggaagccatgacttcccctaagctgccggtgctgcctctgaactcatgtggaggttcttttttcagtgtccccagaggcagcagaaaaatccgttttccattttggaatctatcaagtaggacaaatctgccacctgggagcatctcctcaagggcaatctctgctccctttcctacatggcctgacaataccctcgagttagaaatgtcccatgttggctaggcacagtggctcatgcctgtaatcccagcactttgggaggctgaggtgggaggattgcttgaggccaggagttttgagaccagcctgacatagagagactatgcctctattattttaaaaaa

SEQ ID NO: 281177 - DNA, 1205 bp, Homo sapiens
gagagacaaggaaatgctgtcaccgcggttaacacgcacgtggaggtggttaaagggaagacctgggttttagtcctgtctccatcaacctcaagaaatgggacctcatggaagggaggggaggcaatgccgaggatgtgctcctgagcaggtgccacaattcttcacctgtaagattgctgacagaaaagtgagacctcctccaccccaaggtctcctaagagaatgctgctagccaaaaaaagatctgctgataattgaggaagagcatctttaaaaagacactcaactacatttcagaaacataaagatctaagtgttggctctacaagggaagaaataaagagaaagaactttttttcctcctacaacaggtctagacaacgtcatacaaggagttgcacgcatatccaaaacaaaagcaaggcaaaaacaagcaaaaaagcaacaaatgcattccaaaatgatgtccatttatcagcccagaaatgtactggatactggtttagttcagcctgtaggtgctgggaagaaattccgacaaatccaagtcagttgcaaaaagggaaaactccagacatatcacccaatgaacttgtaagaaagcatatgagcttccctgaacagattttactccaggtttgcagcccgcaagatttaagatggggccatgaggttaaatcttgtaaactcagaagtgttcacgctactgcatccctaaactctgtaactctctacatactctttaaagcagtgtttctctgcatctttcattccatagccattgtccacctgatccaaaatatcctaagtttttcagtgtttggaagcagggtttccaatttttgtgtatacagaaaaggggggtgtgtgtgaaaaaataagtattagaaaaaaaacatgttatacatatctatcacagaaatgagtgggcaaggtttagaagatggctgaaaccaagccaatactaaggtctactggttggctgcaacaagtttaaaatgtcttcataagggccctggttgggcaatactatacttgctgacagtacttgggatctgccacagacctatagcaaaggactgttcaacttctccaaaaagctggtattaaccaccagaagaaataagaagttcaaggccaaaatatccaaatgaaccaaccactctacttgctgaaatgccataaagcttctttaccccaga

SEQ ID NO: 281178 - DNA, 907 bp, Homo sapiens
gagagacaaggaaatgctgtcaccgcggttaacacgcacgtggaggtggttaaagggaagacctgggttttagtcctgtctccatcaacctcaagaaatgggacctcatggaagggaggggaggcaatgccgaggatgtgctcctgagcaggtgccacaattcttcacctgtaaggcctctccagaggcccaaactttaatagaatctgagagaaaaaagtggccagtctatctgctgtccagagtgatgccaaactctttctcccggagccagttctccccgttgggcagtcaggaaacaataagtgaacaagaagtaacctcagaagaagaaagaactttgggagaatgcactgagaaaggccagactgagtccccttggatgaagttaattaagaaacaaacatgacaggatattgcaatcaaaaccaaggaatgcagtgaggacaggtttctcagttgcccagaggagaaaacatagttccttctgaactaaaattagaaagccgctggcaaggaaacataagaagcatggataagaggctgaaaaccgtaagtcagcaatggggatggaggtgggtacaggaagagagcgagtatctattttgttttatttcttctgtaattccttaagattgtttgcgcctgagctttgggactgcagtagtctcccctacggggcgtcaagtaacaggctgggagctctggcaagaagttctcaaacttctcacaattctgctaagagcttgcagatatctagctggaagatcaaggatccaagtaaaaacattaaaggaaggtttttgcccactccccggtgagaggtcatctgcccagggagtgctctcgtgtcctgacaccatcgcccgactggggatatatcagtaaccgggctgtcgtcgatgcc

SEQ ID NO: 281179 - DNA, 384 bp, Homo sapiens
aaataagaagttcaaggccaaaatatccaaatgaaccaaccactctacttgctgaaatgccataaagcttctttaccccagacatttgcccaaatcttataatttcttttctcctctctgacaggcctctccagaggcccaaactttaatagaatctgagagaaaaaagtggccagtctatctgctgtccagagtgatgccaaactctttctcccggagccagttctccccgttgggcagtcaggtgaggatccgattattaacaaactctacttgggtctccttggcaaagagtttctggcttcagcagcctagctcaggggggttcataattatgtcagactcgctttttttcttgtagttgcttttaaccaaagaggttaa

SEQ ID NO: 281180 - DNA, 2122 bp, Homo sapiens
ggacgactggactgcctgtgttcctgttgctcttcacagaagctccatgaaagcgggcttcgcttttgttcatgcagccagaggctcaacacatgacctcgaagccgccaaggctttatcaaacggatttctcccaaaaacttcgtttccttccgcgacgccctgcaagaaccctgtattcctgagtccctggctcagcgtctgctaccccgatgctgtcaatcagatcctgctaatctgagcggccgtggctccgtcccggctccgcgtccgctgacaggtcaccgctgtgagtctccggattaccagtccaaacgggacggcttgaggtccccgcgccctagggacctgcggggcccgagcgcagggcgcgccagagaactacatttcccacagagctcttgggaagccggggccgccgagacccacggcccggcgggcgggctcgcggggagactcctgggagttgtagtccattccgccggcgccggcgctggcgctgctgcgggctcggcgccggcctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattaaacaacaacagacaaacaacaaaaggggacacgctaaaaaataacaccacgcaggggacgcaagcctcagggcagaaccgaggacttgcccacaggggcccaaatacagacagccagaacgccagcgcacgcacatgacagcagtaaccaagacgagacggcaacactgcaccgggaacaacggaacagacaccctacagacgaggagggacccaccaggggcaccacaacacaagcagcgattacagccacagcaaacacaccgacagcggtcaacagggccacacaccgaacaagcccgccccgcggcaccaagatggccaggagcagacgcgggaactattcgcagcggagagaaaacgaacacacccaacacagcaacggcgacagaccaaaaacagacaggaggaacgccagagaccaagaagacgaacaaaggcgatagccaccaaagagcacgacgacaaggacgacaggacggccgagcgacaccgc

SEQ ID NO: 281181 - DNA, 444 bp, Homo sapiens
cagtacactgctatggagaatgcctatttgagtcagctctaacttacctagctctgtgacctttgacaggctccctttgctcccattatctgtatcactctcatggcattgttttcaggattgcattgtctatgcaaagaataaggcctggcacatcataagcactcaaagtattatgtttctttttccctattctaaccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281182 - DNA, 633 bp, Homo sapiens
ggacgactggactgcctgtgttcctgttgctcttcacagaagctccatgaaagcgggcttcgcttttgttcatgcagccagaggctcaacacatgacctcgaagccgccaaggctttatcaaacggatttctcccaaaaacttcgtttccttccgcgacgccctgcaagaaccctgtattcctgagtccctggctcagcgtctgctaccccgatgctgtcaatcagatcctgctaatctgagcggccgtggctccgtcccggctccgcgtccgctgacaggtcaccgctgtgagtctccggattaccagtccaaacgggacggcttgaggtccccgcgccctagggacctgcggggcccgagcgcagggcgcgccagagaactacatttcccacagagctcttgggaagccggggccgccgagacccacggcccggcgggcgggctcgcggggagactcctgggagttgtagtccattccgccggcgccggcgctggcgctgctgcgggctcggcgccggcctttgtctgcgggcacgcgccgctgcggtgagtgaggccgctggccgggtcagagcgcgggggcaaggcggggctgcgccatcaaaccgctgtcccgggccctccggggttt

SEQ ID NO: 281183 - DNA, 340 bp, Homo sapiens
ccagcgaagctgctcacagaggctcaccctttgaccactttcctggtgcacagccagactccctctctgggtgaagctttttccacactggccgccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281184 - DNA, 1199 bp, Homo sapiens
gcggccgccaaggaaatgagcaggcctggccggcccgggccccgagggaggccagccgcgagcggagaggtcggcggtccgcagagcagggtcccgtggaccggagagcgggatgccgaggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281185 - DNA, 1259 bp, Homo sapiens
tgttgactttttccttctcacatatcaattattctgccctttcctgtttgtttctgtttgtttttctccctcaggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcagtgagtgagtcagttgatggctggatgcgctcagctcacagatattcagtgtccctgttctcagcactggtcggcagtctgaggaagcagaggagaccttgctttgatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281186 - DNA, 1672 bp, Homo sapiens
ggacgactggactgcctgtgttcctgttgctcttcacagaagctccatgaaagcgggcttcgcttttgttcatgcagccagaggctcaacacatgacctcgaagccgccaaggctttatcaaacggatttctcccaaaaacttcgtttccttccgcgacgccctgcaagaaccctgtattcctgagtccctggctcagcgtctgctaccccgatgctgtcaatcagatcctgctaatctgagcggccgtggctccgtcccggctccgcgtccgctgacaggtcaccgctgtgagtctccggattaccagtccaaacgggacggcttgaggtccccgcgccctagggacctgcggggcccgagcgcagggcgcgccagagaactacatttcccacagagctcttgggaagccggggccgccgagacccacggcccggcgggcgggctcgcggggagactcctgggagttgtagtccattccgccggcgccggcgctggcgctgctgcgggctcggcgccggcctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattaaaaaaagtcgacgcggccgcgaatttagtagtagtaggcggccgc

SEQ ID NO: 281187 - DNA, 572 bp, Homo sapiens
ggtggtgatctgaggatccctctccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281188 - DNA, 899 bp, Homo sapiens
gcggccgccaaggaaatgagcaggcctggccggcccgggccccgagggaggccagccgcgagcggagaggtcggcggtccgcagagcagggtcccgtggaccggagagcgggatgccgaggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281189 - DNA, 999 bp, Homo sapiens
  misc_feature (32)..(32): n is a, c, g, or t
  misc_feature (49)..(49): n is a, c, g, or t
tgacggtgtctgcgagtagcagccacactcangagggagaggagcccanggaggaacagtaacataactaagacatttgacatataaactccttgagggtagggcttggcactacgtacaagattttagagcacctggctcagctgcccataccctggagcatcggtgccaaatggccccagaacaccgtcgaaggtgtttccctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtaagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattaaaaaaagtcgacgcggccgcgaatttagtagtagtaggcggccgc

SEQ ID NO: 281190 - DNA, 1627 bp, Homo sapiens
ggacgactggactgcctgtgttcctgttgctcttcacagaagctccatgaaagcgggcttcgcttttgttcatgcagccagaggctcaacacatgacctcgaagccgccaaggctttatcaaacggatttctcccaaaaacttcgtttccttccgcgacgccctgcaagaaccctgtattcctgagtccctggctcagcgtctgctaccccgatgctgtcaatcagatcctgctaatctgagcggccgtggctccgtcccggctccgcgtccgctgacaggtcaccgctgtgagtctccggattaccagtccaaacgggacggcttgaggtccccgcgccctagggacctgcggggcccgagcgcagggcgcgccagagaactacatttcccacagagctcttgggaagccggggccgccgagacccacggcccggcgggcgggctcgcggggagactcctgggagttgtagtccattccgccggcgccggcgctggcgctgctgcgggctcggcgccggcctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281191 - DNA, 1309 bp, Homo sapiens
  misc_feature (32)..(32): n is a, c, g, or t
  misc_feature (49)..(49): n is a, c, g, or t
tgacggtgtctgcgagtagcagccacactcangagggagaggagcccanggaggaacagtaacataactaagacatttgacatataaactccttgagggtagggcttggcactacgtacaagattttagagcacctggctcagctgcccataccctggagcatcggtgccaaatggccccagaacaccgtcgaaggtgtttccctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281192 - DNA, 1069 bp, Homo sapiens
cacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagtccacactgtccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcatta

SEQ ID NO: 281193 - DNA, 644 bp, Homo sapiens
gcattgtctatgcaaagaataaggcctggcacatcataagcactcaaagtattatgtttctttttccctattctaactcagcattattggtgcttcttatatgacttccctctcattttatcagatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagc

SEQ ID NO: 281194 - DNA, 361 bp, Homo sapiens
cacactcatagggtcctgtgtcattccttgtgacactgagtagagtgagggtcctgttgccattggacagctgcagcctgggactgaccgggaggctctgattgtttatccaccacagaccaggatctcccctctgggctgcagatgcctaagaagaaaggaactgaaccaactctggtattggggtccacagatgccaaataaggcccctggagtagaggagaggttaagactgtggctgaagacaaatctcctgtaactgatcttccagttacggtctgtgtgaccttgatatagtgactgtatttattgccatgtggctcagtttcccctcagtgaaatagtataaatggttaatggt

SEQ ID NO: 281195 - DNA, 285 bp, Homo sapiens
ctgcctgagcctctcggattacagtttcaggtatgtctttatcagcagtgtgaaaatggacgaatgcactaatacaacaggctccctggtcccccaccttctcggactaagtcctctgcagtgttgactccgtgttctatgagcttctggcagtcatctagtggtttaatggtctcctgttcaatggtgtccacctcttgcaaaagggtcaccaatcgctcatccaggagctttccaagggttccctttaaatcattaaaatgctgtttgagaacatcccttgtc

SEQ ID NO: 281196 - DNA, 7640 bp, Homo sapiens
actcactatagggctcgagcggccgcccgggcaggtaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281197 - DNA, 565 bp, Homo sapiens
taacaatttccccagggaaccagctatgacatgattacgattttaaatcgccccacaatagggaatttggccctcaaggcccaagaattcggcaacgagggggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281198 - DNA, 329 bp, Homo sapiens
gcggccgcctactactactactgcgaattcaagcttctaacgatgtacggggacatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281199 - DNA, 417 bp, Homo sapiens
ccctgagagggaggctgtatcctcagcctcagcctcagcctgacttcctgggccacctgttgcttgaagccacaggagtggcccctcctaatttgacttcctgtcctccataggatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcaggtgaggctttagcccttccctccc

SEQ ID NO: 281200 - DNA, 7953 bp, Homo sapiens
ccacctcggcctcccaaagtgttgggattacgggcatgggccacctctcccagcttgttcttgcattttgtaagatcacatagagtatcaaaactggaaaggacctgggccatcacttccctgagaaaaagtgactttctcaaggtcatgcagttagtagcaatgctggaactgaacgcctaccccgcagatcacaacatgacccgtgaaaggacctatcctgcaacactttggagtttcgtgccgacccaattagtggctttgtctttgggaaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281201 - DNA, 6984 bp, Homo sapiens
tgcccctggctgctgatgccttctgtgacagcttagcattctacttcattccgtcctggtttcctccttagccattgtttaaggggcactggggttttcccaccttgtgtctagcctttgggaaccttcccaactctgaagagctacacagttcttccttcctccgcttctgctaagagagtccccccaaaagcagaatcagctcctgggataagccacatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281202 - DNA, 684 bp, Homo sapiens
cccgggaggtcaccatattgatgccgaacttagtgcggacacccgatcggcatagcgcactacagcccagaactcctggactcaagcgatcctcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281203 - DNA, 5440 bp, Homo sapiens
ccacctcggcctcccaaagtgttgggattacgggcatgggccacctctcccagcttgttcttgcattttgtaagatcacatagagtatcaaaactggaaaggacctgggccatcacttccctgagaaaaagtgactttctcaaggtcatgcagttagtagcaatgctggaactgaacgcctaccccgcagatcacaacatgacccgtgaaaggacctatcctgcaacactttggagtttcgtgccgacccaattagtggctttgtctttgggaaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccaggtagctgccccctttactatctgcacagagggatgtcggggagggggaaaggatacgggatgggaggtggtcagggctgcaggggcagaaaatacccttttggactaaacatctgcctgctttgcttggcctggtatggagtttgatgacaagtgctccccctgctggccaagctctccttgcacgcaagagctctcactccaggcccactggccagaaaggaaggcatggttgaatctgatgtttcaaaatttctaattttttaaagagttacaccatttttcaaatggataagcaaaatgtcatatgtacatacagtgggatattattc

SEQ ID NO: 281204 - DNA, 289 bp, Homo sapiens
aaccaccaggatgccctggggctcctgcatgccacgtgagttgtaacatctgccttttctgactatgtgttcttgtagaagccagggcacgacactgcccatcagtgatctgagccagccctggggaaaatggtaaagtgggtgtggatattcagggattttccatttctcctttttgctttttctttctcattttcccttcaatgttatattgtcatttttcaaacatacaacaaaattgaaaattgtacagtgaatacccatgtgcctaccacctagattctattgt

SEQ ID NO: 281205 - DNA, 290 bp, Homo sapiens
ctcactctgtccatcatacagatctggtacaaaccattactctctcctctctggggattctcagctactcacatttcagcccattctggtccagatgagcgcagctgtgaaaagcccttcttccagctgtgacgaaaaaggctatggccctgaagctcccctccctcttctttttcccaacaggatcccagtgtcttggctgtgagggaaaaccgaggtaagggaactgctctccatcttcatccagtcgggctgccgaaaactgcagtctctgccccgattcctttttc

SEQ ID NO: 281206 - DNA, 300 bp, Homo sapiens
tgggtgtcctgacctgctccctttcttttatagctatgaagatttctacctctcctgctccctcagccatggcggcaaggagctgtgcagccccctgcagacccgaagagctcacttctccaagtacctcttccacctcatcgtctgggaccagcagtaagcccttcccccaggcttcagtgcccaggccactgtagacctgctcagcctctgaaatatccctggggccagataactagtccaggactaatgataaaaccaggctccttgttaaccctaactggacaagtcattcaacct

SEQ ID NO: 281207 - DNA, 183 bp, Homo sapiens
cttcccggaccaggaggtgcgtcgtatggctgtgcagtggattggctcactctcagatgctgagctgctagactacctgccccagctggtacaggtgggtggattggtcctccctccagttttgctggtcccatccccagtatcccaagtgagtctgcattctgccccttagaaaccagagat

SEQ ID NO: 281208 - DNA, 436 bp, Homo sapiens
ctctccagccacatctttctctctttctctcatactagatggcgtcctttgcagcaaaccgtaagttataaggatgagggaagaagagtagagggccaaaaggattccattttgaggaaaaactacagtttgccttgccaggtagaagaatcaggtatgagttctttttgtctcaggtaataaactaagcaaagcccagatagtagtaatgatggagcccttcaactattgacgtctccctaagagccctcattttttgaaagcagagtgtttgtcccattcctgactcgccatgctgtgtgtctcccagagagtgaaagaaattgctgtgactgcgagcaccagtagagtggatttaattctcaccaagaaaagggaggtggtttgcaaatgggttgttttgggatcctgggagaggaacattgtagccagagat

SEQ ID NO: 281209 - DNA, 352 bp, Homo sapiens
gatccctggagtgccctgactcctgactccctctgccttgcaggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcaggttagtggggtgaggctgcccctacccatttctcatccagggctttggcagccagtttcttcttaggaatcctgaacaacaagattccacgtgacgatttttgattttggagcggggagcagctgact

SEQ ID NO: 281210 - DNA, 662 bp, Homo sapiens
tacgtaaaaataaggattatgtttaacattgtataactgtcattttatgaaaagctcatgacatgcttctgcttttttctcattttaccgcagatgggtgaactttgtcacagctattagagactgactagcatttggggaccactgtcttaggccatcccattctagccaatgccatggcaacaaggtagggcttgtggaggcctcatgactttcccttctgaccccttcccttcccagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagtaagcccttcccccaggcttcagtgcccaggccactgtagacctgctcagcctctgaaatatccctggggccagataactagtccaggactaatgataaaac

SEQ ID NO: 281211 - DNA, 8304 bp, Homo sapiens
  misc_feature (8260)..(8260): n is a, c, g, or t
ccacctcggcctcccaaagtgttgggattacgggcatgggccacctctcccagcttgttcttgcattttgtaagatcacatagagtatcaaaactggaaaggacctgggccatcacttccctgagaaaaagtgactttctcaaggtcatgcagttagtagcaatgctggaactgaacgcctaccccgcagatcacaacatgacccgtgaaaggacctatcctgcaacactttggagtttcgtgccgacccaattagtggctttgtctttgggaaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaaggcagaagccctattactttgcaaggggcccttcagaagtcgctgggctcagaaggctcttagtcgtgcttgagagtgagcctttcgaagagatactcgcccgagcccgagctccgggccacccagcctgtggaggttggtcaggtggtcacccatcttcttgataagcttcacttcctcatctaggaagtgagtctccaggaagtcacagagatgggggtccgtgcgggcagaacccagggcatgaagatccaaaagggcctggttcagctttttctccagggccatggcagctttcatggcgtcntgggttttaccccactcgatcttcagctggcttcttgatgtcct

SEQ ID NO: 281212 - DNA, 4032 bp, Homo sapiens
ccgggcgggcgtgacagatcgggaaacagcttctagtcatgctggttgaggcaattgtgcgcaggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaa

SEQ ID NO: 281213 - DNA, 325 bp, Homo sapiens
cggccatctttgacctggtgtgagctgagtgagcaggtcaggggtgtgaggctggggaactccctgtcactgttagtttagggccaaggttgagcacttgggagacctgagagctggggaggtagtggagattagatctggtcactttctccctccatccagtgtggggacgaccttcgccaggacatgctaacgctgcagatgattcgcatcatgagcaagatctgggtccaggaggggctggacatgcgcatggtcatcttccgctgcttctccaccggccggggcagaggtcagttgggagtaggggtgagggtggaggagg

SEQ ID NO: 281214 - DNA, 5021 bp, Homo sapiens
gaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagaattgcctgcggaggtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggatttttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaataaaactttgtttgtcagttatttta

SEQ ID NO: 281215 - DNA, 5214 bp, Homo sapiens
gggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagaattgcctgcggaggtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgtgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggatttttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaataaaactttgtttgtcagttatttta

SEQ ID NO: 281216 - DNA, 4371 bp, Homo sapiens
agtggatgctccgcgggaaggagaaccctaagcccagaaaaccgcaccctctggaaaacctctgtaccatccgtcgcttcctgaaacttacccagcatgagagggatgtcatctatgaggaggagtcaaggcatcaccacagcgaacgcatgcgacacgtggtccagcttccccctgagccggtgcagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgtgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggatttttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaataaaactttgtttgtcagttatttta

SEQ ID NO: 281217 - DNA, 2989 bp, Homo sapiens
  misc_feature (1477)..(1477): n is a, c, g, or t
  misc_feature (1540)..(1540): n is a, c, g, or t
  misc_feature (2062)..(2062): n is a, c, g, or t
  misc_feature (2937)..(2937): n is a, c, g, or t
gcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagaattgcctgcggaggtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacaggtacaattagcattaaacactgtaattaacagtaatactggggacagaattgagataggttataattatttttatctctttaaaaagctttatggatctcaggacatagaattagattaattaataatccttagttaatgaaacgctattaccattgatccatgcatgaccatgattaattaactaattgattaattttgatgaggtaatggacatctttgaacccaacatgcaactcaggaccccaaatgttactaatgacttgggtatgtactctctcatcctctccatttactgtttncagatgtaaccctgatcttgaattttgtgattatcagtctcttgccattttttaaaacaaatnataaaactatgcatgcccagacaatctatttttttcccttggttttgaacgttataaaagaaataaaattatgttttataattttataagtaaagttttatttaaaaatttataaaaatccttcaaaacataaaagttagatttaagatattgataaaatgataatggatagtttacttttatttttaatgtttgagagaattatatgccaattataacactaaatgttgaaaatgtaaacagttaattcacacgtcttatttttattgagggtgcttatatgtaagacattcttttctgctagtagttcttaaactggagtgtgcatcagaatcacctggagggctgtgaaacacagactgctgggcctcatcccatagtttctgattgagtaagtctgaggttggactcagaaatggacatttctaacaagatcccaggtgattatgatggtactgatccggggccgcatgttgagaaaaacttacctagcccttatatgagtaagaacaaagcagatgngcataatctcggggagctaacgatctagtggtgaaaaccaggtaaccagataattagagtaaaatgtgaagtgttatgagtaatgttggagagtgtaagcaatagttgtggtggaggttcatggtgagctggaggtgaggaatacttccaggagaatgaatatggtaagccttcaagaaaacagtagattaaaatttcagcaccctcgtaaatgcaaggcaggaagctaagctctatgtgggtgcaaagaggaaaaagataatgggcaagcacatatgtaaacaacagagtattaggttgtcaatgggttagaccttgaaggattaataaagtacagcaggcaaagatgatgaagaagaagattattattttaaggtaaagacattcataggaaagatgttgagttaaaaaatgcaggaataatttgaagacataaaacaactgatttctgagaaaaaccctgtgaacgtacagaatgtaggaatgctttcatttatctgatacctgttcagagacacatgataacacacgctgtagatggaccttacaaatgaaagaaagcatgctggattgaaacctcaataatttggaaaatacaggaatgtttccaaatttaatgattacttcagaagttaaggggctgggcacagtggctcatgtctgtagtcctagcactttgggaggccaaggtgggcggatcacttgaggtcaggagttcaagaccagcctgggcaagatggtaaaacaccatctctactaaaacagaacaaaacaaaaaaattagctgggcgtggtgatgcgtgcctgtagtctcagctactcaggaggctgaggcagaagaatcccttgaacccaggaggcggaggctgcagtgngccgagatcatgccactgcactccagcctgagtgagagtgaaactccatctc

SEQ ID NO: 281218 - DNA, 4886 bp, Homo sapiens
gcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagaattgcctgcggaggtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgtgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggatttttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaataaaactttgtttgtcagttatttta

SEQ ID NO: 281219 - DNA, 4522 bp, Homo sapiens
tccattgttgacattgccccagggttggctttttggagaaagcactatcattgtataaattaaagggatggtaaattcaggtaatcgtgtttgatgttaatagttcagtttacaggagagtgactgttttaagtttaaaagaaaaaagaggttagtgcaggttataaagtgctctttcttgtccctaaaaagaagtagtcatattttgaaaaaataactataattttttttttcagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgtgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggatttttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaataaaactttgtttgtcagttatttta

SEQ ID NO: 281220 - DNA, 1413 bp, Homo sapiens
gcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagaattgcctgcggaggtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggcccatcacgctgccatttatgcg

SEQ ID NO: 281221 - DNA, 2624 bp, Homo sapiens
gccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttcttta

SEQ ID NO: 281222 - DNA, 3701 bp, Homo sapiens
  misc_feature (3553)..(3553): n is a, c, g, or t
  misc_feature (3601)..(3601): n is a, c, g, or t
  misc_feature (3624)..(3624): n is a, c, g, or t
  misc_feature (3682)..(3682): n is a, c, g, or t
gccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccggaacaatcctgtgagtttatgatatctgctatacagatgaggataacagaagttgactaacttgcccaagtcacaagtttgtaaagatggatctgggatttaaacccagtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281223 - DNA, 3441 bp, Homo sapiens
  misc_feature (3293)..(3293): n is a, c, g, or t
  misc_feature (3341)..(3341): n is a, c, g, or t
  misc_feature (3364)..(3364): n is a, c, g, or t
  misc_feature (3422)..(3422): n is a, c, g, or t
gccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281224 - DNA, 3446 bp, Homo sapiens
  misc_feature (3298)..(3298): n is a, c, g, or t
  misc_feature (3346)..(3346): n is a, c, g, or t
  misc_feature (3369)..(3369): n is a, c, g, or t
  misc_feature (3427)..(3427): n is a, c, g, or t
gccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281225 - DNA, 2102 bp, Homo sapiens
  misc_feature (1954)..(1954): n is a, c, g, or t
  misc_feature (2002)..(2002): n is a, c, g, or t
  misc_feature (2025)..(2025): n is a, c, g, or t
  misc_feature (2083)..(2083): n is a, c, g, or t
cttatttttgtatttttagtagagatgaggtttcaccatgttggccaggctggtctcaaaatcctgacctcaggtgatccatgtgtcttggccttccaaagtgctgggattacaggcttgagccactgcacctggcccagtgttttgatatatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281226 - DNA, 1805 bp, Homo sapiens
  misc_feature (1657)..(1657): n is a, c, g, or t
  misc_feature (1705)..(1705): n is a, c, g, or t
  misc_feature (1728)..(1728): n is a, c, g, or t
  misc_feature (1786)..(1786): n is a, c, g, or t
gggccaggcgcggtggctcttgcctgtaatcccagcactttgggaggccgaggcaggcggatcacgaggtcagagatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281227 - DNA, 1812 bp, Homo sapiens
  misc_feature (1664)..(1664): n is a, c, g, or t
  misc_feature (1712)..(1712): n is a, c, g, or t
  misc_feature (1735)..(1735): n is a, c, g, or t
  misc_feature (1793)..(1793): n is a, c, g, or t
cccacaaaaaaaaattattaatatagtgtagtctcagtgtagtggtagcacgtgattgttactgtatggatgcgtgttgtagatcttatgaaagtgtggtcttcgaatagtagtggtcccgttttgtgcctctcatggtgcgatgaccgctagtgtggggggatacaccgtgcgggccgctcccattgaggtgggactttttgtgagacaatgccccgaaataggcttagtgtattccgttggtatccttacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281228 - DNA, 1005 bp, Homo sapiens
  misc_feature (857)..(857): n is a, c, g, or t
  misc_feature (905)..(905): n is a, c, g, or t
  misc_feature (928)..(928): n is a, c, g, or t
  misc_feature (986)..(986): n is a, c, g, or t
gctgccgctactactactaaattggcggccgtcagacaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281229 - DNA, 510 bp, Homo sapiens
ttatttttatgttttttcgtcactttctgccttattctttcagaatacctatgctcagttcattgatttaccattacctttagtttcttaactttccagaatttagtttcccactcacacctcaagtcttgacagtgtgggtcttctttatatgtatactgtttaaagaaaaactaatatgtgaacatccaaacctttaaaaataaagtagaagagaatactacccatgtctttatattacaagtttttaaccccatattttaaaaatgtgatttgtgcaaaattaaatgaatttgcttaaagtgctgtaatgagagagaagagaaagtattttacttaaatatattgttcttcaaacgtatgttgttttgctttttaaaaatcattcccttgtagggatttgttcctgggctgtttggaacatcgcatggtgcccttcagtttatggcatatgaattgctgaagttgaagtacaaccagcatatcaatagattaccagaagcccagttg

SEQ ID NO: 281230 - DNA, 412 bp, Homo sapiens
atataatgtcatgaagttttatgatgcatgcacaaataattatgttattgacaagtaatctttatcgagtatttactaggagcaaggcagtgaactatgctttagatgcattatctcatttattatcctgtaaatctattcacaggaacaatcctgtgagtttatgatatctgctatacagatgaggataacagaagttgactaacttgcccaagtcacaagtttgtaaagatggatctgggatttaaacccaggtaatctaactctggaaccctctggcacttaacccctcaccgtattacctctataagtacctgttatacaatggtttgaacattggaagaattttagacttgcctgcaggtgcaggcctgtatgacttgctgtctgtcttcagtagcattttatctag

SEQ ID NO: 281231 - DNA, 3592 bp, Homo sapiens
  misc_feature (3444)..(3444): n is a, c, g, or t
  misc_feature (3492)..(3492): n is a, c, g, or t
  misc_feature (3515)..(3515): n is a, c, g, or t
  misc_feature (3573)..(3573): n is a, c, g, or t
gccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281232 - DNA, 3287 bp, Homo sapiens
  misc_feature (3139)..(3139): n is a, c, g, or t
  misc_feature (3187)..(3187): n is a, c, g, or t
  misc_feature (3210)..(3210): n is a, c, g, or t
  misc_feature (3268)..(3268): n is a, c, g, or t
ggacgcgtgggtccggacgcgtgggtcgacgctcgacctcggtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281233 - DNA, 3538 bp, Homo sapiens
  misc_feature (3390)..(3390): n is a, c, g, or t
  misc_feature (3438)..(3438): n is a, c, g, or t
  misc_feature (3461)..(3461): n is a, c, g, or t
  misc_feature (3519)..(3519): n is a, c, g, or t
gccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgtttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaaacctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttcatcttggtgtaagtgacagaaaaggaaatatatgcataatgtaatttcaggtatttaatgctataaataaaactacagcagaacgggggaatagtgttgctatcttaggtagtatggttggggtcaggaaaggtctctgagatagtatttggaacattttgaaagaagtgaggaagcgaaccgcagttgaaagacgctgcgtctttcaactgcggttggcttttgaatgaggatgacaatggaagagatgaagaatgaagctgagaccacatccatggtttctangcccctctatgcagtcatgtatcctgtgtttaatgagctagaacgagnaaatctgtctgcagcccagacantgagagccgctttcatcaaggctgaaaaagaaaatccagtctcacacaagacatcatnatgaaattttagagaaaaa

SEQ ID NO: 281234 - DNA, 1079 bp, Homo sapiens
gcggccgcggaggaggtgcggccccaaggggaggaggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggttggggaagcaaactggaacccatggcaataataggagggtgtccaggctgggcccctcccctggtcctcccagtgtttgctggataataaatggaactatggctcta

SEQ ID NO: 281235 - DNA, 418 bp, Homo sapiens
ggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggtaagaagggcctcccgccacgggcacgggggccaagaacacgcgacccgaagatggagataaagagacagagacacactgccgcggagagagacgaacacaaagacagagacacaggaaccaccgaaaagaccccacggagaaggggatagggacacgtccatgggaacagagggggatacagcctg

SEQ ID NO: 281236 - DNA, 897 bp, Homo sapiens
gcggccgcggaggaggtgcggccccaaggggaggaggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccaaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggttggggaagcaaactggaacccatggcaataataggagggtgtccaggctgggcccctcccctggtcctcccagtgtttgctggataataaatggaactatggctcta

SEQ ID NO: 281237 - DNA, 690 bp, Homo sapiens
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatca

SEQ ID NO: 281238 - DNA, 742 bp, Homo sapiens
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcacgatgcggctgtcctttttttcatatctcccaccgacccatatatctagaat

SEQ ID NO: 281239 - DNA, 749 bp, Homo sapiens
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcatccccgatgcggccgaacactctctaacataaatctttttaaaaattctgccaatcacc

SEQ ID NO: 281240 - DNA, 749 bp, Homo sapiens
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcaacgggcagcgtcaaatttttccttttttctttaatctttttatagtgatagaggggggg

SEQ ID NO: 281241 - DNA, 118 bp, Homo sapiens
agaaattccttgaaatttgcaaggtaggaggcatcttgggtattactctcagattagctttgttgctggagctatgtgcttctagggacgtgtactcctaaacaaaacaaaataaaat

SEQ ID NO: 281242 - DNA, 736 bp, Homo sapiens
  misc_feature (716)..(717): n is a, c, g, or t
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcaaaaaaaaaagggaaaaaaagaaaaanngatggcctcgttggcctca

SEQ ID NO: 281243 - DNA, 718 bp, Homo sapiens
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcaagtcggccgaaagtcccctctcgtccat

SEQ ID NO: 281244 - DNA, 871 bp, Homo sapiens
catgccatcccgttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagcaatagtctggcactttcatttgccaagctatttcttattcaaaggccacccaaagtcccagctctctaggaaaacaaatgatctccatctggaatgtgagaggatgagtactttgatccagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatacgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcaacgggcagcgtcaaatttttccttttttctttaatctttttatagtgatagaggggggg

SEQ ID NO: 281245 - DNA, 827 bp, Homo sapiens
cggccgcccccactgcatgaccttctgggatttgtagtagtcagggccacgcggctgggcgcgccctctagcagcagccctgagtgaccgcagcgcacgagcgcgggaaaatgaggctgcgcgggctgaagagcgcaccgagaggagccgcccccgcggtaccgcgcagcctcgcgtcccgtcagtggggaacaaggtcttggagttaggtcaacaggagaagagtcaagtgaggtcacagatgagttgaattactaggaacaagtcaagaagcctcaaaagaatcaaggcgtaaaataccaagaatggccttcattggttgcaataggaagcgaaagaggagacctgaaatcaaatgaaaaagcgtaagcatcctggggagaagcccactggatctcagttctgccctgctcaggaaagttcagtatccaggtgactgagaacagaaccggctggcaccaaagacatgattttgagggggccggagccctttccctttgcctccatacataacaggagcaggaccacacactcagtccctgacaagaaaaggagggtggattttctaaactatgatattcaccattaaaattaacaagttaacagaagtaatattttttgaaaacaggttttctaattgtactacacatgatcatgacttcttaaatggaacacatgtacatgaagactgggaaccaaacaaatgttaacttatgagtatcaactgctccttataccctcacacagtgacagcagtgggagttatttagcaggatagggctttttgctcccagcctatagtgttccagctcgtgtggttttccgct

SEQ ID NO: 281246 - DNA, 480 bp, Homo sapiens
cggccgcccccactgcatgaccttctgggatttgtagtagtcagggccacgcggctgggcgcgccctctagcagcagccctgagtgaccgcagcgcacgagcgcgggaaaatgaggctgcgcgggctgaagagcgcaccgagaggagccgcccccgcggtaccgcgcagcctcgcgtcccgtcagtggggaacaaggtgaggggaaaacttattttacgggattcaaaggattaggatatgctccttccccgaaggggtttatagcctagctgatgaggtcggccagacgcagagaacagagaggcaaaattcggttataaagggctcgaggcggccgggcggggaggctagtcagggaggctcgaggctgaactgcaggcttcacgttaaagttacaagtgagttggacccagaaggcagaattacagccagaacgtagctgtgcatcatgtcttgaaaataaacgagcacatgtaata

SEQ ID NO: 281247 - DNA, 302 bp, Homo sapiens
gtcctttccctttggtgactaaatcatgccgtgccattcatggtctcttttttagctagtctaaaacgtgtagtaagtggaaagtaatcaagcttcaagttccacatataatctttccttcttcttcattatactaatgctttcatatttactattcctagatccatatctgatttctttcttccttctcagataaatgtgcagtctagccattagaagaccaaaaggaccaaaatttccacaggggggaaaaaaaagaaacaaggcttgcaataaaattgtttaagtcttcatcagaaatg

SEQ ID NO: 281248 - DNA, 556 bp, Homo sapiens
tggctactattaaatcctaccatctcaaaaggatataacagacaagaaggccatcaaccccatttcccaccatggaagagaaggacagaagagaacaccagtcacttttcctaagaacgtttaaccacagcaactctacacactaaaatctgaacaattagacctccagctgacctcagcttctacactccgaaatccatggccacatatgcagcaaggataaatatctcatggcttttctccacattaactggaagtagcagaaataagaagaccagctcattcccgaggggcatgggactccaatgagggacaactctgacttgacgactatccaaggtcttggagttaggtcaacaggagaagagtcaagtgaggtcacagatgagttgaattactaggaacaagtcaagaagcctcaaaagaatcaaggcgtaaaataccaaataaatgtgcagtctagccattagaagaccaaaaggaccaaaatttccacaggggggaaaaaaaagaaacaaggcttgcaataaaattgtttaagtcttcatcagaaatg

SEQ ID NO: 281249 - DNA, 1381 bp, Homo sapiens
taaggtaaataccctctttagctgagtccaagactttggatattagattactgtacctaaaaagagtaaaatggtggccaggcggtggctcacgcctgcaatcccagcactttgggaggccaaggagggtggatcatctgaggtaagatatagtcagggaaattaggattcatgcttgaagagtaatagaaaaacctaagtgaaacaggttattggaattttctttatgaagaataaaagtggaagaactgatagtctggaaaggtgaagtaatctggagtaggcagctacaaaaggtataaaatttgtggagaaggcaaaaattggggcagaaaatataaataacaagggagtactgcagtcctctggtgggaggtagatcataaagaatctgtagaaccatttacttttcctcacagtcaactgctcttacacccagagcagtagctgtcaagtcaattttattgaaaatacactggacttggacatcctgagtcaaactgccatcacctaaagggcctggatttaaaaggaattttcaagattattgttaacttctgggttaagtgtttagggaaaaaaatgttaaatctacttttcttatacatgattggtgtgcttagttttttatcaatttgacactacagtccaaatttgcttctgatcacactagaatagttttaccaatgttcattatttttcaacttcctttattaagaattaaggctggttgggcgcagtggctcacgcctgtaatcccagcactttgggaagccgaggtgggcagatcatttgcggtcaggattccaataccagcctggccaatacggtgaaaccccatttctactaaaaatacaaaaattagccaggcgtggtagcgtactcctgtaatcccagctactcaggaggctgaggcagaattgcttgaacccttgaggcagaggttgcagtgagccgagattgcgccactacactccagcctgggccacagagcgagactgtgtctcaaaaaaataaaaatagaagactgcactaatgccaccaacgtgcatattgatttgaaggcatcttgcagcaacttttaaaaattattgtacatatatatttaaaagcatactttattaatgtgcttattaaaaagtttagggaaaactttaagtgttcaaaatgtcaagtttgttaggcatcagtttgttagtgtttgggagtattgcctcagatatctgggcaaaattttttcctcccataatattaaattattggctgacagttaatgaattttgccaataagtaaaataatcaagaagttacaaaaaggataagatactcagctatcttggccttcaaaacgccaatggtggattctaactgaaattttata

SEQ ID NO: 281250 - DNA, 1853 bp, Homo sapiens
taaggtaaataccctctttagctgagtccaagactttggatattagattactgtacctaaaaagagtaaaatggtggccaggcggtggctcacgcctgcaatcccagcactttgggaggccaaggagggtggatcatctgaggtcaggagttcgagaccagcctggccaacgtggtgaaaccccatctctactaaaaatacaaaaattagccgggcgtggtggtgcacgcttgtggtcccagctactcaggaggctgaggcaggagaatcgcttgaacctaggaggtggaggttgcagtgagccaagatggcaccactgcattcctgcctgggcaacaagaaagagtaaaatggtaactatgcacaaaggatgggggaaaggtggctcacagggcttaaacatcagaggaatggagaggacaggacagtgagggaattatctggaaggtaggtaactggattgagaaccacaaaaagcatgtagatttaagcagattacgagtcattttaaacagctgtttcaaagtaagagtaaaaacaggctggagaaaatcttgggtaatattagagtaacatagtctaggataggaatccatcagttatggagatcagaggtaagatatagtcagggaaattaggattcatgcttgaagagtaatagaaaaacctaagtgaaacaggttattggaattttctttatgaagaataaaagtggaagaactgatagtctggaaaggtgaagtaatctggagtaggcagctacaaaaggtataaaatttgtggagaaggcaaaaattggggcagaaaatataaataacaagggagtactgcagtcctctggtgggaggtagatcataaagaatctgtagaaccatttacttttcctcacagtcaactgctcttacacccagagcagtagctgtcaagtcaattttattgaaaatacactggacttggacatcctgagtcaaactgccatcacctaaagggcctggatttaaaaggaattttcaagattattgttaacttctgggttaagtgtttagggaaaaaaatgttaaatctacttttcttatacatgattggtgtgcttagttttttatcaatttgacactacagtccaaatttgcttctgatcacactagaatagttttaccaatgttcattatttttcaacttcctttattaagaattaaggctggttgggcgcagtggctcacgcctgtaatcccagcactttgggaagccgaggtgggcagatcatttgcggtcaggattccaataccagcctggccaatacggtgaaaccccatttctactaaaaatacaaaaattagccaggcgtggtagcgtactcctgtaatcccagctactcaggaggctgaggcagaattgcttgaacccttgaggcagaggttgcagtgagccgagattgcgccactacactccagcctgggccacagagcgagactgtgtctcaaaaaaataaaaatagaagactgcactaatgccaccaacgtgcatattgatttgaaggcatcttgcagcaacttttaaaaattattgtacatatatatttaaaagcatactttattaatgtgcttattaaaaagtttagggaaaactttaagtgttcaaaatgtcaagtttgttaggcatcagtttgttagtgtttgggagtattgcctcagatatctgggcaaaattttttcctcccataatattaaattattggctgacagttaatgaattttgccaataagtaaaataatcaagaagttacaaaaaggataagatactcagctatcttggccttcaaaacgccaatggtggattctaactgaaattttata

SEQ ID NO: 281251 - DNA, 1765 bp, Homo sapiens
tgagacagagtctcattctgtcacccaggctggagtgcagtgacgtgatcttggctcactggaacctccgcctcccaggttcaagtgattctcttgcctcagcctcccgagtagctgggattacaggcgtctgccaccacacagggctaattttttgtatttttagctgaggcaggagaatcgcttgaacctaggaggtggaggttgcagtgagccaagatggcaccactgcattcctgcctgggcaacaagaaagagtaaaatggtaactatgcacaaaggatgggggaaaggtggctcacagggcttaaacatcagaggaatggagaggacaggacagtgagggaattatctggaaggtaggtaactggattgagaaccacaaaaagcatgtagatttaagcagattacgagtcattttaaacagctgtttcaaagtaagagtaaaaacaggctggagaaaatcttgggtaatattagagtaacatagtctaggataggaatccatcagttatggagatcagaggtaagatatagtcagggaaattaggattcatgcttgaagagtaatagaaaaacctaagtgaaacaggttattggaattttctttatgaagaataaaagtggaagaactgatagtctggaaaggtgaagtaatctggagtaggcagctacaaaaggtataaaatttgtggagaaggcaaaaattggggcagaaaatataaataacaagggagtactgcagtcctctggtgggaggtagatcataaagaatctgtagaaccatttacttttcctcacagtcaactgctcttacacccagagcagtagctgtcaagtcaattttattgaaaatacactggacttggacatcctgagtcaaactgccatcacctaaagggcctggatttaaaaggaattttcaagattattgttaacttctgggttaagtgtttagggaaaaaaatgttaaatctacttttcttatacatgattggtgtgcttagttttttatcaatttgacactacagtccaaatttgcttctgatcacactagaatagttttaccaatgttcattatttttcaacttcctttattaagaattaaggctggttgggcgcagtggctcacgcctgtaatcccagcactttgggaagccgaggtgggcagatcatttgcggtcaggattccaataccagcctggccaatacggtgaaaccccatttctactaaaaatacaaaaattagccaggcgtggtagcgtactcctgtaatcccagctactcaggaggctgaggcagaattgcttgaacccttgaggcagaggttgcagtgagccgagattgcgccactacactccagcctgggccacagagcgagactgtgtctcaaaaaaataaaaatagaagactgcactaatgccaccaacgtgcatattgatttgaaggcatcttgcagcaacttttaaaaattattgtacatatatatttaaaagcatactttattaatgtgcttattaaaaagtttagggaaaactttaagtgttcaaaatgtcaagtttgttaggcatcagtttgttagtgtttgggagtattgcctcagatatctgggcaaaattttttcctcccataatattaaattattggctgacagttaatgaattttgccaataagtaaaataatcaagaagttacaaaaaggataagatactcagctatcttggccttcaaaacgccaatggtggattctaactgaaattttata

SEQ ID NO: 281252 - DNA, 2373 bp, Homo sapiens
aattggtcaccccaatgcaggggatacagacttgttttaatataaaaaagaagtggccttaaccgtgcagggcttgcaggcctttgtaggcatgggagcatgctgtgatccctggttctgtgctaaacactcaaaagggctctctgactcaagtggaggtgataaaccttttcaatagtaacaggagagagtgtgatatcaaagtgccagaagtcctcacggaccaacatttagcacagacattcaaactgctgaaagaaccaaacagaactcaactgaaaaaaacagaccttttaagaaaagcaatagatcttaatttggtggcaagatccctggtttaccttttgaagtcaaaatgttcaatacatcacccgagcttgacttttgagcacttggcaagattgttttttgccacttgacacaagtatgatgtccagctatgcaaaatgactgtttgatctgccttttcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcaacccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtccgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaacacaaaaaaaaaat

SEQ ID NO: 281253 - DNA, 2709 bp, Homo sapiens
attgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgccaaacataagcgatacttcggtcactcggctcacgtgacgaacatccgtttctcttatgatgacaagtatgtggtcagcactggaggagacgactgcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcaacccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaacacaaaaaaaaaat

SEQ ID NO: 281254 - DNA, 1852 bp, Homo sapiens
attgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgccaaacataagcgatacttcggtcactcggctcacgtgacgaacatccgtttctcttatgatgacaagtatgtggtcagcactggaggagacgactgcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcaacccaaggcttcctaaatgaaagacatcggttacctgcttatgggaaggtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaacacaaaaaaaaaat

SEQ ID NO: 281255 - DNA, 2293 bp, Homo sapiens
atgaggtccccctggggaagcaggtaactgaagccgtggtcattgagaagatcacctgggcctcctggacaagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgccaaacataagcgatacttcggtcactcggctcacgtgacgaacatccgtttctcttatgatgacaagtatgtggtcagcactggaggagacgactgcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcaacccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaacacaaaaaaaaaat

SEQ ID NO: 281256 - DNA, 941 bp, Homo sapiens
aattagatacatggagataaccaaagaatgatgaaaggcaatcagtccaggatacaggggagagagaaggtgttctaaagaaagcaatggaaaagagaaaacggccctcaaaaggaaaacaatgagaaactgtcttgattgtacttgtaagaaatgattgtgcggttaatattattttttgaaccctgacattcagagtcagtcacctggcacatagtggatgcttaataacaggtgtggaataaattggctgctacttgcccgggcagtgggccagactcataaacatagtggccattcagaatcctgcaacgttcatgttttcgtgtattagcggtggaaaataataggaacaaggcgagacctggacttcagtcccagctctgccactaagtggcttggctgtagagcttaactcttccacagtcttcatctgtgtaatgggaataacgatccgtacctctagcaggtgcgaggcgggttgtaaatggccacgcccgggagccgcaagaaccacggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggg

SEQ ID NO: 281257 - DNA, 548 bp, Homo sapiens
aattagatacatggagataaccaaagaatgatgaaaggcaatcagtccaggatacaggggagagagaaggtgttctaaagaaagcaatggaaaagagaaaacggccctcaaaaggaaaacaatgagaaactgtcttgattgtacttgtaagaaatgattgtgcggttaatattattttttgaaccctgacattcagagtcagtcacctggcacatagtggatgcttaataacaggtgtggaataaattggctgctacttgcccgggcagtgggccagactcataaacatagtggccattcagaatcctgcaacgttcatgttttcgtgtattagcggtggaaaataataggaacaaggcgagacctggacttcagtcccagctctgccactaagtggcttggctgtagagcttaactcttccacagtcttcatctgtgtaatgggaataacgatccgtacctctagcaggtgcgaggcgggttgtaaatggccacgcccgggagccgcaagaaccacggtgatccgcgcggccgcaggtgggctgggg

SEQ ID NO: 281258 - DNA, 892 bp, Homo sapiens
aattagatacatggagataaccaaagaatgatgaaaggcaatcagtccaggatacaggggagagagaaggtgttctaaagaaagcaatggaaaagagaaaacggccctcaaaaggaaaacaatgagaaactgtcttgattgtacttgtaagaaatgattgtgcggttaatattattttttgaaccctgacattcagagtcagtcacctggcacatagtggatgcttaataacaggtgtggaataaattggctgctacttgcccgggcagtgggccagactcataaacatagtggccattcagaatcctgcaacgttcatgttttcgtgtattagcggtggaaaataataggaacaaggcgagacctggacttcagtcccagctctgccactaagtggcttggctgtagagcttaactcttccacagtcttcatctgtgtaatgggaataacgatccgtacctctagcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggg

SEQ ID NO: 281259 - DNA, 469 bp, Homo sapiens
ctggcctccgctgacccccgccccgcccgtctcgtcggtcccgcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggg

SEQ ID NO: 281260 - DNA, 616 bp, Homo sapiens
ccagatgaagttttccctcaagcacagctggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggg

SEQ ID NO: 281261 - DNA, 402 bp, Homo sapiens
gccagatctttcaagcctaccagaatactgacagcacttcagcttctgagaaacatagtacaggtgactgcatctgcacaggcttccctgggaggacttcatcaacagcacagttacacatcaaagtcctttagctctccccagctggcgcctattttcactttcactttcaatttcacagacagttttacagcactttccatttcattcttgacaatctgagctacctaaggaaaaaaaaaatgtagttaacaaactgcccagtcaaagaatgtttcccaaaccatcccctgagaaagttataaaccagactggagctcttcacccaatggtgcttaaaatgctaaatcagaaaaaataaaaaataaaataaataaatgaataaataaaaagacatctcat

SEQ ID NO: 281262 - DNA, 1100 bp, Homo sapiens
ctcgtgcgctcctccttcctacagaaaaatgtgtttctaggcaacggcgggcggcggcgtcacttcctgccatttaaactcaggtccccacccctcgcagccccttctcctcgtttccacccctcccccctcggtcgtgggcctcattcacgcttccccgggcttggggagggggcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggtgagctccggaggcggggacgggggcggacttcggaacccgtggcccccggggaagcccagcccctcgccgcgtgggtctagcggcgtggtgtagacgcgccttgcggggacccgggaccgggcaatccgaggaccatgtggcctgcgcccgggtcgtggacgccgggatgggggagggacgagggaccaggatggcaccgagcggacgcgtaaccaatggggcccggcgccacgctgggctctcgacaaagagcccaggacctcgagcgcgcccgcgtggcttctgtctccgggcgcagggacctgagggtaaccgagtgtctgttgctctgcgtccacctgtggcagaggctcacggggtaacgggcgctttgcccggagacaccgtggatatcgattttgctgttaagaatggatggttttaataggcgattccagttggaaccatgttcctgtagtttaaataaaaaggaggaaaaacaaaacccagtctg

SEQ ID NO: 281263 - DNA, 461 bp, Homo sapiens
tagtattggaagtgttgagtgaccgtatgagagtgagagtaagagaaactgagttgcttttttcctgtatccttacagtgaccaaaatctttctaggctacagtgctgtcatcccgcatctatacaagaaacctggatcaaatacttttagtcccttctaacataacaatacgtctctgaatccttcctggaccttcttgtcttaatggaagacccctgatgacagcttccctcgcagtcctcctcttgagtttaacagaggtttttgtttgaattgcagatgtcttcaaagatacaagaattactgaggagaaaaagaatgggtgctcactgacatcccatgtcttgcctctattaatacattcttacatttgagtttagagataagaactgtttcccatactatggtttttaaatgagttctatggttcagtaaaactattaaattgaagcttcacaca

SEQ ID NO: 281264 - DNA, 1834 bp, Homo sapiens
ctcgtgcgctcctccttcctacagaaaaatgtgtttctaggcaacggcgggcggcggcgtcacttcctgccatttaaactcaggtccccacccctcgcagccccttctcctcgtttccacccctcccccctcggtcgtgggcctcattcacgcttccccgggcttggggagggggcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgttgaccaaaatctttctaggctacagtgctgtcatcccgcatctatacaagaaacctggatcaaatacttttagtcccttctaacataacaatacgtctctgaatccttcctggaccttcttgtcttaatggaagacccctgatgacagcttccctcgcagtcctcctcttgagtttaacagaggtttttgtttgaattgcagatgtcttcaaagatacaagaattactgaggagaaaaagaatgggtgctcactgacatcccatgtcttgcctctattaatacattcttacatttgagtttagagataagaactgtttcccatactatggtttttaaatgagttctatggttcagtaaaactattaaattgaagcttcacaca

SEQ ID NO: 281265 - DNA, 1565 bp, Homo sapiens
ctcttataggcagcataagttgagtgtttttaaaaatccatttaactactttgcctttttattggagaacttaatccacttacgttcagggttatcattcataggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattc

SEQ ID NO: 281266 - DNA, 1378 bp, Homo sapiens
gctgttctagaggtcccgattgtgaataggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattc

SEQ ID NO: 281267 - DNA, 635 bp, Homo sapiens
taagcctaggaagtggcatgtcagaagtcaacaaagatgtgataaacttaaagtgctaaaacagaaggcacttcacaaaatctgttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattc

SEQ ID NO: 281268 - DNA, 2065 bp, Homo sapiens
ctcgtgcgctcctccttcctacagaaaaatgtgtttctaggcaacggcgggcggcggcgtcacttcctgccatttaaactcaggtccccacccctcgcagccccttctcctcgtttccacccctcccccctcggtcgtgggcctcattcacgcttccccgggcttggggagggggcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattc

SEQ ID NO: 281269 - DNA, 939 bp, Homo sapiens
ctcgtgcgctcctccttcctacagaaaaatgtgtttctaggcaacggcgggcggcggcgtcacttcctgccatttaaactcaggtccccacccctcgcagccccttctcctcgtttccacccctcccccctcggtcgtgggcctcattcacgcttccccgggcttggggagggggcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggtgagctccggaggcggggacgggggcggacttcggaacccgtggcccccggggaagcccagcccctcgccgcgtgggtctagcggcgtggtgtagacgcgccttgcggggacccgggaccgggcaatccgaggaccatgtggcctgagggtaaccgagtgtctgttgctctgcgtccacctgtggcagaggctcacggggtaacgggcgctttgcccggagacaccgtggatatcgattttgctgttaagaatggatggttttaataggcgattccagttggaaccatgttcctgtagtttaaataaaaaggaggaaaaacaaaacccagtctg

SEQ ID NO: 281270 - DNA, 1833 bp, Homo sapiens
ttagatgagactgtttatgaacagagaaataagataggaggtgacatggataggcaattagtagctcctcctcaggattagtccataaggtgacacaaagtattcttattgtgttcttttatttttgcaggctttgtgtcatgaccttaatttctttttctgttccaacatctgctagcttttaaatggaataatttctttggtatttgcagtgtttgggagatgctttgaacatgctcagctattgtccccaagcaactgagtgggtcaaatttgagattggacttgttgtggatttaataatcaaccctttttggctttaaaatatgacttgccctttatttcactgttctcgttgtctttcctgaacaggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattc

SEQ ID NO: 281271 - DNA, 1685 bp, Homo sapiens
ttaagccctgtgagccacctttcccccatcctttgtgcatagttaccattttactctttctgttgcccaggcaggaatgcagtggtgccatcttggctcactgcaacctccacctcctaggttcaagcgattctcctgcctcagcctcctgagtagctgggaccacaagcgtgcaccaccacgcccggctaatttttgtatttttagtagagatggggtttcaccacgttggccaggctggtctcgaactcctgacctcagatgatccaccctccttggcctcccaaagtgctgggattgcaggcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatgatgcaatttctcagatgaactgattgtagtgactacctctaaaagccttcaatctacagtttttaaatttgtctcattgcatctgagttttagaaagccttcgatagaaagggaagatacttcatagcttgccagatgaatgcccatttccttatttccttttcctcacttttgatattttgcccagtgtctggtctggatatctgacatccataagggtattgaaatggatccttgtgtggttttcagataccagttatatatattatgaagcagaggtaacctaatattgtctaacactattgatacagtttatattttggaaatactgtatggatgatttattgaaataacttata

SEQ ID NO: 281272 - DNA, 1326 bp, Homo sapiens
ttaagccctgtgagccacctttcccccatcctttgtgcatagttaccattttactctttctgttgcccaggcaggaatgcagtggtgccatcttggctcactgcaacctccacctcctaggttcaagcgattctcctgcctcagcctcctgagtagctgggaccacaagcgtgcaccaccacgcccggctaatttttgtatttttagtagagatggggtttcaccacgttggccaggctggtctcgaactcctgacctcagatgatccaccctccttggcctcccaaagtgctgggattgcaggcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatg

SEQ ID NO: 281273 - DNA, 1454 bp, Homo sapiens
agcggacgggcgcgcgcacgccgccttcgccgctggctccgtctgttggggggcgaacacgccgcggtcctcgcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatgatgcaatttctcagatgaactgattgtagtgactacctctaaaagccttcaatctacagtttttaaatttgtctcattgcatctgagttttagaaagccttcgatagaaagggaagatacttcatagcttgccagatgaatgcccatttccttatttccttttcctcacttttgatattttgcccagtgtctggtctggatatctgacatccataagggtattgaaatggatccttgtgtggttttcagataccagttatatatattatgaagcagaggtaacctaatattgtctaacactattgatacagtttatattttggaaatactgtatggatgatttattgaaataacttata

SEQ ID NO: 281274 - DNA, 347 bp, Homo sapiens
ttcgtgggatggtatcttctgaaaaggaaaagtaaacactttatggagtctatggtttagcttaaagcaatattgagggatgcaaataataatatcaacactattacaaagcatgccaggcactattctaagccctttacataaatacccaattaatctaactaatgacccatgaacttggtactatttttatctccactttacagataaggacattgaggcacagagaagctaagtaacttgctcaagatcacacagatactaagtgtcccagctaaaattcaaatccagacagtctggctcctgagtcctcacctttaaccactctgtgacactagttctttatg

SEQ ID NO: 281275 - DNA, 798 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccggtaatcatgtgaaaataactattttctgtgaagtaatgttttgattgattgcttttatatatatggaataatatctatgtattttataggcaatcatgttagctgttgaagtgcctctgtagtactgtaataaaatacaagaattaccgtggactttcagtttcagtttcttttcttttctttgtttttttgagacagagtcttgctctgtcacccagtctggaatgcagtgagtgtcatgataacagctcactacagcctcaacctcgtgggctcaagtaatcctccgacctcagccttctgagtagctgagaccacaggcacgtgccaccacgccgagctaatttttaaattttttttgtagagatgaggtctccctgtgttgcctaagctggtgtcaaactcctgagctcaaatgatcctcctgcctcggcctccacagggatgacaggcatgagccactgtgcttgtcctggat

SEQ ID NO: 281276 - DNA, 1287 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281277 - DNA, 1413 bp, Homo sapiens
gactcagatcgcttcttgttggtatgtgtagcggcagtggccgccggcggagcagtctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281278 - DNA, 763 bp, Homo sapiens
  misc_feature (30)..(30): n is a, c, g, or t
  misc_feature (56)..(56): n is a, c, g, or t
  misc_feature (65)..(65): n is a, c, g, or t
  misc_feature (83)..(83): n is a, c, g, or t
  misc_feature (91)..(91): n is a, c, g, or t
  misc_feature (101)..(101): n is a, c, g, or t
  misc_feature (119)..(119): n is a, c, g, or t
  misc_feature (130)..(130): n is a, c, g, or t
gcctaagctcactataatacttctccatcnaatgcttatcgatgggacactccttnagacattgncgatcttgttggataccnggatgccntcgaggctgncagtcttgttacaagttnaatcccacatncaatgctcaatgctgaggacagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281279 - DNA, 407 bp, Homo sapiens
  misc_feature (296)..(296): n is a, c, g, or t
gtggaaacttgatgaggtacaaaataaatctgtagttaaatgtagaatttaacttgttgacttaataagtttttgagagactggaagaaggggagaaagactgtattcaataatcaagttggaggccagacgtggtggctcacacctataatccctaccgtttgggaggccaaggcaagcagatggcttgagcccaggagttcaagaccagccttggcaacatggcaaaaccctgtctctaggggaaaaaaaaaaaatacaaaaattagccgagcatggtggcacgtgcctgtagncccacctccttgggaggctgaggtggaaagatcacttgagcctgggaatgtcaaggctgcagtgagccataattgcaccactgcactccagggtgacagcgagaccctgtt

SEQ ID NO: 281280 - DNA, 878 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaaaagataaaataaaacaatttgctactgccagatgcttctctcttttctggggccttctgtttccattgggccaatcaagatgcctggaatgatgtcgtcagtaatgcctggaatgatgatgtctcatatgtctcaggcttccatgcagcctgccttaccggtaatcatgtgaaaataactattttctgtgaagtaatgttttgattgattgcttttatatatatggaataatatctatgtattttataggcaatcatgttagctgttgaagtgcctctgtagtactgtaataaaatacaagaattaccgtggactttcagtttcagtttcttttcttttctttgtttttttgagacagagtcttgctctgtcacccagtctggaatgcagtgagtgtcatgataacagctcactacagcctcaacctcgtgggctcaagtaatcctccgacctcagccttctgagtagctgagaccacaggcacgtgccaccacgccgagctaatttttaaattttttttgtagagatgaggtctccctgtgttgcctaagctggtgtcaaactcctgagctcaaatgatcctcctgcctcggcctccacagggatgacaggcatgagccactgtgcttgtcctggat

SEQ ID NO: 281281 - DNA, 924 bp, Homo sapiens
gactcagatcgcttcttgttggtatgtgtagcggcagtggccgccggcggagcagtctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccggtaatcatgtgaaaataactattttctgtgaagtaatgttttgattgattgcttttatatatatggaataatatctatgtattttataggcaatcatgttagctgttgaagtgcctctgtagtactgtaataaaatacaagaattaccgtggactttcagtttcagtttcttttcttttctttgtttttttgagacagagtcttgctctgtcacccagtctggaatgcagtgagtgtcatgataacagctcactacagcctcaacctcgtgggctcaagtaatcctccgacctcagccttctgagtagctgagaccacaggcacgtgccaccacgccgagctaatttttaaattttttttgtagagatgaggtctccctgtgttgcctaagctggtgtcaaactcctgagctcaaatgatcctcctgcctcggcctccacagggatgacaggcatgagccactgtgcttgtcctggat

SEQ ID NO: 281282 - DNA, 942 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaaaagataaaataaaacaatttgctactgccagatgcttctctcttttctggggccttctgtttccattgggccaatcaagttcctgctaccacatgagcccaagtcgtcactctcccatgcctaggttattcaacagtttttgaatgcctggaatgatgtcgtcagtaatgcctggaatgatgatgtctcatatgtctcaggcttccatgcagcctgccttaccggtaatcatgtgaaaataactattttctgtgaagtaatgttttgattgattgcttttatatatatggaataatatctatgtattttataggcaatcatgttagctgttgaagtgcctctgtagtactgtaataaaatacaagaattaccgtggactttcagtttcagtttcttttcttttctttgtttttttgagacagagtcttgctctgtcacccagtctggaatgcagtgagtgtcatgataacagctcactacagcctcaacctcgtgggctcaagtaatcctccgacctcagccttctgagtagctgagaccacaggcacgtgccaccacgccgagctaatttttaaattttttttgtagagatgaggtctccctgtgttgcctaagctggtgtcaaactcctgagctcaaatgatcctcctgcctcggcctccacagggatgacaggcatgagccactgtgcttgtcctggat

SEQ ID NO: 281283 - DNA, 145 bp, Homo sapiens
catggatttgctggtgcagtacaactaggcttaatagggacatgggagcaggctatgaaaatgattattaatgatccacgatacagtgctttggcaaagttaagtgaaaaaaagcaagcctttaatgcctataaagtccagacag

SEQ ID NO: 281284 - DNA, 1359 bp, Homo sapiens
gactcagatcgcttcttgttggtatgtgtagcggcagtggccgccggcggagcagtctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaagcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281285 - DNA, 1330 bp, Homo sapiens
atcgaaccctctcctccgaacccctcctttcgccttccccgcctcctcccctccgcctcgagcaccgcgcgcgcgatctcggtcccagccaccgctaacactacaggctgcttacccccgccccctccaccctacccctggcggcctcagatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281286 - DNA, 1195 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggagataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281287 - DNA, 273 bp, Homo sapiens
catggatttgctggtgcagtacaactaggcttaatagggacatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaatctacatgaataaaaggatgtaataaggaaggtaaataagcaatcagaagtatata

SEQ ID NO: 281288 - DNA, 463 bp, Homo sapiens
ggttattcaacagtttttgagttgagttggttttcttgcttcaaggatgcccccctgcccccacaaattttagatttcaatgtgttatctccttgcccaagaatctccagtactttcagtgcctataacatagtatctaaattccacagcttaactttaaagaacctccccatagtacatgtcaaagcaggattcaaggctgcatgtctttacactccctaatttgaacttaggctggtcttttcacggtgtcttgagtgattatattagttcacaacttcaaacttaggctgttcttcttaccctcctgcccccagctcagtatcaccatgaagtttgctttgcttacctatgttgtactatttcaagtcctgccttctccaaaagtttctcaaaaatgacttttgccaacatatacctccccttcagattattaaagaaaatatttgtaatctacccataa

SEQ ID NO: 281289 - DNA, 571 bp, Homo sapiens
aaaccactaatatttgattcttttgcctgtgtttactcttacatggtatttttatattagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaagtaagatgtttagtgttacatggcctatgtttactacattgttgtttgtgtcatacttttctgccatgtgcagtagctgatccagagctcattaaataaaactagatgattatgaatgtggaaacttgatgaggtacaaaataaatctgtagttaaatgtagaatttaacttgttgacttaataagtttttgagagactggaagaaggggagaaagactgtattcaataatcaagttggaggccagacgtggtggctcacacctataatccctaccgtttgggaggccaaggcaagcagatggcttgagcccaggagttcaagaccagccttggcaacatggcaaa

SEQ ID NO: 281290 - DNA, 1606 bp, Homo sapiens
  misc_feature (497)..(497): n is a, c, g, or t
  misc_feature (631)..(631): n is a, c, g, or t
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgctaaactaaacggatattcactctgaagtgggataaatgaagatgtggagtttcatgttcatgtagggcaggttttgccactatagtgagttttggtaccatacttgaaaaaagttggctttcagagggttttggtttccagaattgtgggtaaaggattgaggaccttgtgtacanttggtgaccatataacatttaaactactcccgtagtctcggttgctgatctcttttacaatttatagcaagctcggggaactgagaccactaaaagttttgctaagaatatgagtcagaggcttgaggattatncatagcagccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281291 - DNA, 356 bp, Homo sapiens
  misc_feature (245)..(245): n is a, c, g, or t
gcctactactactataccgctgtgagaagacgacagaaggggagaaagactgtattcaataatcaagttggaggccagacgtggtggctcacacctataatccctaccgtttgggaggccaaggcaagcagatggcttgagcccaggagttcaagaccagccttggcaacatggcaaaaccctgtctctaggggaaaaaaaaaaaatacaaaaattagccgagcatggtggcacgtgcctgtagncccacctccttgggaggctgaggtggaaagatcacttgagcctgggaatgtcaaggctgcagtgagccataattgcaccactgcactccagggtgacagcgagaccctgtt

SEQ ID NO: 281292 - DNA, 1415 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaatctacatgaataaaaggatgtaataaggaaggtaaataagcaatcagaagtatata

SEQ ID NO: 281293 - DNA, 934 bp, Homo sapiens
gactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 281294 - DNA, 470 bp, Homo sapiens
agcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgagtaagtttagtaacttgtcttctgaaaatcagtaccagattgcattaaataaaagtaattgccagtttagttagtggccattaatagtttaaataaatttttttgagaatcgtaatatcaccgttaagacagttgatcagttttcaggccgaattttggagggttatgccagcaaacttgaaaaatagttcagtgaaattttaacaagtagagccaaggct

SEQ ID NO: 281295 - DNA, 1821 bp, Homo sapiens
  misc_feature (1816)..(1820): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281296 - DNA, 1718 bp, Homo sapiens
  misc_feature (1713)..(1717): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281297 - DNA, 1728 bp, Homo sapiens
  misc_feature (1723)..(1727): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281298 - DNA, 1747 bp, Homo sapiens
  misc_feature (1742)..(1746): n is a, c, g, or t
agcagcggttgttggagtgtaactgccatgctcagccgcgatggctggggctgccgggcgcgtccaagatcgcgccctgcggcggtttcccatcaccctgcctgtgggcgacttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281299 - DNA, 1678 bp, Homo sapiens
  misc_feature (1673)..(1677): n is a, c, g, or t
tgggaaggcggctctaacttggctgatgcaactgcgagaaaagttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281300 - DNA, 1679 bp, Homo sapiens
  misc_feature (1674)..(1678): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281301 - DNA, 1774 bp, Homo sapiens
  misc_feature (108)..(108): n is a, c, g, or t
  misc_feature (1769)..(1773): n is a, c, g, or t
gcccccggctcccggaggtcgacattttggtttccataggcaaagtcctaacaccacaattgacatagttaaaaaggggagacggtaacgtgtttggtagaggttacntatcttgctatagttgtttattttagttgctgagtgatacacagccctcaaagagtctgacattgtgcccatggttacacttgtccgggggagaccttgaatttggtgtggaagaaataacatcagtagttcagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281302 - DNA, 949 bp, Homo sapiens
  misc_feature (949)..(949): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagtccgccgtgtactctacgggcaccccatggcaacccaggttgcgcctcgcacacgtgcggcgacccacaagacccggctctcggggaatggcaagcggggtgccccgagaaattgaccagccgccgaacatctcacccacgggccaacgggggcggtggtgcatatgacgaaaagccaccgtgcacgcgacn

SEQ ID NO: 281303 - DNA, 1772 bp, Homo sapiens
  misc_feature (1767)..(1771): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281304 - DNA, 1625 bp, Homo sapiens
  misc_feature (1620)..(1624): n is a, c, g, or t
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaannnnna

SEQ ID NO: 281305 - DNA, 2274 bp, Homo sapiens
atttttttttttataaagaatatgcaatccatttgggatttattgcatttaaagaaaacagattaaaacaggtatgataaatacagtaagaaaataactttaaatttcaaacaaaacagtgaatcagggacagaattcagtcaaaaagaataagcagtgtaaaggcaataaagtaataaaatcagttagtgcttaattagatatggcaggggaaaaggggtgggagggggagactgagtctatctcataattgtttcccagctatatttgaggactgaagttactttagcaagtatgttttgtaacaagtagaaatacaataaagatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281306 - DNA, 666 bp, Homo sapiens
agagagagcctcggctaggtgtggaaacaggaagagaactagaactggaagtaaagcatgaagatgtgactgaatgctgcaatctcatgatcaaatttgaatggatgaggagtgctttttagggatgagcaaagaaagtggtttctcgagatggaatctactggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgat

SEQ ID NO: 281307 - DNA, 2220 bp, Homo sapiens
atttttttttttataaagaatatgcaatccatttgggatttattgcatttaaagaaaacagattaaaacaggtatgataaatacagtaagaaaataactttaaatttcaaacaaaacagtgaatcagggacagaattcagtcaaaaagaataagcagtgtaaaggcaataaagtaataaaatcagttagtgcttaattagatatggcaggggaaaaggggtgggagggggagactgagtctatctcataattgtttcccagctatatttgaggactgaagttactttagcaagtatgttttgtaacaagtagaaatacaataaagatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattgcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281308 - DNA, 1563 bp, Homo sapiens
atttttttttttataaagaatatgcaatccatttgggatttattgcatttaaagaaaacagattaaaacaggtatgataaatacagtaagaaaataactttaaatttcaaacaaaacagtgaatcagggacagaattcagtcaaaaagaataagcagtgtaaaggcaataaagtaataaaatcagttagtgcttaattagatatggcaggggaaaaggggtgggagggggagactgagtctatctcataattgtttcccagctatatttgaggactgaagttactttagcaagtatgttttgtaacaagtagaaatacaataaagatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacaggtacctcctgctgaggaaaagttaggttccaggctgcaagttaccacaatccaagataaccaaacaagtctgaatgttgaaaagctgttcaatgtactcagcagaaatcctaaacactcaattcttcttttggctttacattttgatgatgttacatgtgtaacttgcctgaatgagaaatgaaaggaacagaaccaaaaggatcttctggaggatggttatgtggagcagaaagtgagtctacattcttatctgaggatgctctctcctcgagcctatctgcaaaaataagatgaaacgaaataaaaaatgaaatgaaataaaaatgatctttaaattaaaaagtgatatacatataaataaaagtgaaaattaaagcaccagcctttttgcaaaac

SEQ ID NO: 281309 - DNA, 1475 bp, Homo sapiens
atttttttttttataaagaatatgcaatccatttgggatttattgcatttaaagaaaacagattaaaacaggtatgataaatacagtaagaaaataactttaaatttcaaacaaaacagtgaatcagggacagaattcagtcaaaaagaataagcagtgtaaaggcaataaagtaataaaatcagttagtgcttaattagatatggcaggggaaaaggggtgggagggggagactgagtctatctcataattgtttcccagctatatttgaggactgaagttactttagcaagtatgttttgtaacaagtagaaatacaataaagatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacaggtacctcctgctgaggaaaagttaggttccaggctgcaagttaccacaatccaagtgatgatgttacatgtgtaacttgcctgaatgagaaatgaaaggaacagaaccaaaaggatcttctggaggatggttatgtggagcagaaagtgagtctacattcttatctgaggatgctctctcctcgagcctatctgcaaaaataagatgaaacgaaataaaaaatgaaatgaaataaaaatgatctttaaattaaaaagtgatatacatataaataaaagtgaaaattaaagcaccagcctttttgcaaaac

SEQ ID NO: 281310 - DNA, 2007 bp, Homo sapiens
tggagcggaaaaagctttatcaacaaatatttttttgcaaaatgagaaacccctaaaaatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281311 - DNA, 2406 bp, Homo sapiens
tgccgggtccgccgcggcgctggcggcgagtggccggtgtgagcgcagagccgggccctgggcagcagcggcagcgcggtaggacctcgcgcagcgtccgcgggctccggggcgggggcgccagcggcgaagaccctcctccccggggaggcgggacctgggtggagctcccgagcctggggagctggtggcggacggtgaacgatgcatcagaagctgctgaagagcgcgcattacatcgagctgggcagttaccagtactggccggtcctggtgccccgtggcatccgcctgtacacctacgagcagatccccgggtccctcaaggacaatccgtacatcaccagacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagctttaaaatcatattttagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281312 - DNA, 2243 bp, Homo sapiens
tgccgggtccgccgcggcgctggcggcgagtggccggtgtgagcgcagagccgggccctgggcagcagcggcagcgcggtaggacctcgcgcagcgtccgcgggctccggggcgggggcgccagcggcgaagaccctcctccccggggaggcgggacctgggtggagctcccgagcctggggagctggtggcggacggtgaacgatgcatcagaagctgctgaagagcgcgcattacatcgagctgggcagttaccagtactggccggtcctggtgccccgtggcatccgcctgtacacctacgagcagatccccgggtccctcaaggacaatccgtacatcaccagacggctaccgggcctacctgccgtccaggctgtgtatcaaaaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagctttaaaatcatattttagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281313 - DNA, 1497 bp, Homo sapiens
tgccgggtccgccgcggcgctggcggcgagtggccggtgtgagcgcagagccgggccctgggcagcagcggcagcgcggtaggacctcgcgcagcgtccgcgggctccggggcgggggcgccagcggcgaagaccctcctccccggggaggcgggacctgggtggagctcccgagcctggggagctggtggcggacggtgaacgatgcatcagaagctgctgaagagcgcgcattacatcgagctgggcagttaccagtactggccggtcctggtgccccgtggcatccgcctgtacacctacgagcagatccccgggtccctcaaggacaatccgtacatcaccagacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagctttaaaatcatattttagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggagttaatgccgagaatccatcagaagtatctactgtttagaaggaaatggagcagcaccaaatgggtctaattcgactggttgggactgttgggactgatgtggagtgatgctttgcaccacaagttctgtaaagggcacggcaccaaaatcatccattttcaatacatctgcactatggaatgacccatgtagtgaa

SEQ ID NO: 281314 - DNA, 568 bp, Homo sapiens
taaaagccaaaattactttttcagttcctttattgttaataacagaattaaaatgtgatttcctttcattctagtactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggtaggttgagtgtagttaatatttttctcttttttttcctttcaattttattccttttgggtaaagtagtataatcaggccaagtgggtagatgtttgtcatttgagaacatatttgtaattgcatgttgatgccataattttcacagccatataaataagcataccttgcagaagtcgaggtaaaatctgaatactgattttctctgagttgtctttctgtaaaaaaaaatacattattattctctattacccttagtatataaatacccaagtccttatttgtggaggaggact

SEQ ID NO: 281315 - DNA, 2296 bp, Homo sapiens
tgccgggtccgccgcggcgctggcggcgagtggccggtgtgagcgcagagccgggccctgggcagcagcggcagcgcggtaggacctcgcgcagcgtccgcgggctccggggcgggggcgccagcggcgaagaccctcctccccggggaggcgggacctgggtggagctcccgagcctggggagctggtggcggacggtgaacgatgcatcagaagctgctgaagagcgcgcattacatcgagctgggcagttaccagtactggccggtcctggtgccccgtggcatccgcctgtacacctacgagcagatccccgggtccctcaaggacaatccgtacatcaccagacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281316 - DNA, 1860 bp, Homo sapiens
ccaagcccataaatgtttgaattgaaagcctagcctcttaactacttccctgaatatcatgcataagttgctttagtttctttagtcactttgttaatttgtttttatttttcacaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaacccaaatatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatat

SEQ ID NO: 281317 - DNA, 1553 bp, Homo sapiens
tgccgggtccgccgcggcgctggcggcgagtggccggtgtgagcgcagagccgggccctgggcagcagcggcagcgcggtaggacctcgcgcagcgtccgcgggctccggggcgggggcgccagcggcgaagaccctcctccccggggaggcgggacctgggtggagctcccgagcctggggagctggtggcggacggtgaacgatgcatcagaagctgctgaagagcgcgcattacatcgagctgggcagttaccagtactggccggtcctggtgccccgtggcatccgcctgtacacctacgagcagatccccgggtccctcaaggacaatccgtacatcaccagacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagctttaaaatcatattttagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacaggtgatgatgttacatgtgtaacttgcctgaatgagaaatgaaaggaacagaaccaaaaggatcttctggaggatggttatgtggagcagaaagtgagtctacattcttatctgaggatgctctctcctcgagcctatctgcaaaaataagatgaaacgaaataaaaaatgaaatgaaataaaaatgatctttaaattaaaaagtgatatacatataaataaaagtgaaaattaaagcaccagcctttttgcaaaac

SEQ ID NO: 281318 - DNA, 450 bp, Homo sapiens
taattttagaaatggagtatcactatgttgctcaagctagactcaaactcctggactcaagggatcctcccgcctcagccttccaagtcactgggattataagtgcatgccatcccacgcagctactctcttgaatactcgagaaagccaagcactacaattgtgtggctggtaataattttctcagtgggcaaccaccacagttaatattagtgaaattaaagcaggaacagagctgcctctatgtctacagatgttcccatgagccaggaaacttcgctttcttctcttgaacaaatttctttaaaatctgtcctttacaaactaaaaatctctctcaggtgcatttacgtagcttcaggcctgtgccctagcttgcaaggcctggggcaaaagtccaaatggaggcccacccaccacacacctaaatatttaaacgctgtaaatcaa

SEQ ID NO: 281319 - DNA, 432 bp, Homo sapiens
taattttagaaatggagtatcactatgttgctcaagctagactcaaactcctggactcaagggatcctcccgcctcagccttccaagtcactgggattataagtgcatgccatcccacgcagctactctcttgaatactcgagaaagccaagcactacaattgtgtggctgcttcccaggtattttaggaaatgcaccattcttcgccaaattaagatttttttaaaagccactagtatataatctgcttgaaaggaagattaaatttctcttatccacctttctactcactgctcatcactataaatgaatgcaacaaaagtttctcacagtcatcgataatatcaatattgtgagtatatcttctttaacattgtaatattaatgtttctttatattattgggtgaataaaagccatttatatttgatgg

SEQ ID NO: 281320 - DNA, 2388 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281321 - DNA, 2643 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtataggtgagatgaatgtccctgttccccccaaatctcccagagtgcccctatctgatgtccccagagccccagggatgtttcccttggggaacggagggagttcacctcatccccttttgcctgggggggatgcctgaataggatgcttctgaccactctgcccctgcccctgcagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281322 - DNA, 2898 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtataggtgagatgaatgtccctgttccccccaaatctcccagagtgcccctatctgatgtccccagagccccagggatgtttcccttggggaacggagggagttcacctcatccccttttgcctgggggggatgcctgaataggatgcttctgaccactctgcccctgcccctgcagggagggggcaaggaaggagccattggccgtggtgggctccccatactggatggctccagaggtgttacggggtgagctgtatgatgagaaggtgagacatcaacccttcagatccccaaggccttccgagacccttgaggtattctcataaagccccatccatccccaaaacaaccctaccagatcttcaggagtccccaagatccctttgcccctcacaggcacccttctaacacatgaaaactgtcaagatcccccaccctcaaccaaattctgctatattctgtcaaaattctgaaatgaaaactgttaattcttccccgacactattatctctgacccccaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281323 - DNA, 3308 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccctaaaaaaaaaaaaaaaaaaaaaaaaaaaaaaaaaaaaaaaaaagagaaacaacaaagaaagaaaaaaatagaaaaaaaaaacaaacacaatatagaatagaacaacaatcgcaagaacaaaaaaacaatagacaaaaataagtggggaggcgcgcgcgcactgtccaaatcattctacctcgctcctgggagtggcgctcccggtgagaccgccaccattacacaacttctttttttactcaataacgaggcggagtgcgccccacataaatagagaggaaacaccgagctatatatctatatacaaaacgagcagcggcggggcgggcgcgcggcgcgactctatactacatacatcacactctttgatatcagacccgtggcgataggacgaacacagcagcccatgccatgaaaacccgatgtacgaaacaatatctttcttgagaaaggaaagctaacaaataccataatcattcatattcttgagcggtgcagattgaggagagacgcgcacaaaacaaacggcatgcgcgagatcaaactcacactcacaccaacacaccaaagaaacgagatgattagataccccacacctagctccccaatccataagggagtgagaaacatcatcattaaataagcgcagactgatctcaagcaaggcggagtgtatgctaagctcttggttgcgaggtgaacctcacaaacccaccatgagatccacaatttttatatcatctcgattcccgcagcctagtacgagtaaatagaaacacgtcgttctgacgatctagaatgaacaaggaggaaatagaaaagatcattcaccaacatcc

SEQ ID NO: 281324 - DNA, 2264 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281325 - DNA, 1536 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccactaaccggctttttgcccaaatgggccattatcgaagaattcacaaaaaacaatagcctcatcatccccacatcatagccaccatcaacctccttaactctattctacctacggctaatctatccactcaatcacactaatccccaaa

SEQ ID NO: 281326 - DNA, 130 bp, Homo sapiens
tcaaatgctgaggacagtgattccagacttctctatctacaggctctgttgcaagagggggtccctctgccacgcttcccaggccagatccccggctttcccgaagccggtcagacctcttcctgccccc

SEQ ID NO: 281327 - DNA, 2471 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281328 - DNA, 1921 bp, Homo sapiens
gagagcagagagggttggagttatgctggagtgacagggctttgggttatacattgggaggccagacagcagaaggtgatgagtgcgtggggatactatgtgtgtgtgtgtcagaactgtctagtccgacgggaagatcgaggcttcaccgctgtcgtgggtgacttcgggctggccgaaaagattcctgtgtataggtgagatgaatgtccctgttccccccaaatctcccagagtgcccctatctgatgtccccagagccccagggatgtttcccttggggaacggagggagttcacctcatccccttttgcctgggggggatgcctgaataggatgcttctgaccactctgcccctgcccctgcagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281329 - DNA, 2930 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccctaaaaaaaaaaaaaaaaaaaaaaaaaaaaaaaaaaaaaaaaaaggggggggggcgcaaaaaattccccggggggccccttgcggcaccagcagctttgttgtggttaaagaacggcggggtcccctatataagtgggggtggcattatatataacgacgtgcaggagcgcggggcggcggcgtgtattaaacacaaaggggcggtggcagggggaaaaaagcgcgtggtactgcagtggagctatcttggtgggaggaggcgacaccactctctgggggggggggggggaaactattatgtggggacaaatcctcctgcaggagtggattttaacagcgtcgtgggggtcattaataaaaaatttacgacgggtttatctggggtgttacaccactacgggtcttatagcgtagcgatagaaatattgggtactaagggaattctattcacaatttttacc

SEQ ID NO: 281330 - DNA, 2387 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 281331 - DNA, 1377 bp, Homo sapiens
gcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggtgagacatcaacccttcagatccccaaggccttccgagacccttgaggtattctcataaagccccatccatccccaaaacaaccctaccagatcttcaggagtccccaagatccctttgcccctcacaggcacccttctaacacatgaaaactgtcaagatcccccaccctcaaccaaattctgctatattctgtcaaaattctgaaatgaaaactgttaattcttccccgacactattatctctgacccccaggctgatgtctttgccttcgggattgtcctctgtgagctcatcgcccgagtacctgcagaccctgactacctaccacgcactgaggtgaatgtttctaggtttgcaaagaaag

SEQ ID NO: 281332 - DNA, 3307 bp, Homo sapiens
ctagatgactgccagaagctcatagaacacggagtcaacactgcagaggacttagtccgagaaggtgaaatcgccatgcttggtggtgtgggagaagagaatgggaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaacccttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281333 - DNA, 997 bp, Homo sapiens
aattatgcttgtacaatgattttattagataagagataacacttgtgtgatttattatgtcaaaattatgcaggaatatactaaaatcttttgtaatttgtgggactgatcatgataccctgttaatggaatcttttattttattgaacttgaccatggcccctaagagtagtctcccatttccatgttttatttaacgtgtctgtattgaagatatccctcaagagattctaacagttttcaatatctttgctttgaaaaagagtggacagctggttttgaggggtacagtctgagcagtcgaagaaatatagcacttcggaacgattctgaatcatcgggtgttctctactccagagctccgacttatttctgtgggcagacattaacattcaggcaagtagatattaaaacatctcacctgcctcaggaagcagagtgaagtgcatagagcatacataagctttgaattcaaaacatcctgagtttattccgtcatttataggcagtgttactgtgggaaggcttctttatttcctgtagctgtagttttctcatctgtattcacagggttattacgtagattaactgggaaatgtatataaaatgcttgttatttaatatgtttatatctcttttcctcttggtaagtagaggtaagtagagtatctctcaaaagtcaatcttaggctgggcatagtggttcacacctgtaaccccagcactttggtaggccgaggcaggtggatcacctgaggtcgggagttcgagaccaacctgagcaacatggagaaaccccatctctactaaaaatacaaaatcagccgggcaggtggcacatatgcctgtaatcccagctacttgggaggctgaggcaggagaattgcttgaacccaagaggcagaggttgcagtgagctgagatcatgccactgcactccagcctgggcaacaagagcgaaactctgtctcaaacacacacacaaaattaaaaagta

SEQ ID NO: 281334 - DNA, 498 bp, Homo sapiens
ccaaaaaaaaaaaattagctgggtagtgtctgtattgaagatatccctcaagagattctaacagttttcaatatctttgctttgaaaaagagtggacagctggttttgaggggtacagtctgagcagtcgaagaaatatagcacttcggaacgattgtctgtgactacccatatggtaaaatacatacacagtccaacaaaaggctaatacatagtaaagcctaagcatactactatgtaatattataatacataacttggagactttagttagagtactatgttatctattcagttttgaaaacattcattaagattttaaatgcaaattcattccttatttggaataaaacaaagtcctctaagttataacaagtattggtcataagttttcagacctattcattcaattacaagaaccccagaattctgtgatgtccagtagaagtatataataaaacactgcatatgtttctacttgatatctttatcccgcta

SEQ ID NO: 281335 - DNA, 3724 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281336 - DNA, 3907 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttcagtgtgtgtacttttttcttctgtgagatttggtgaatccagttttaacctacttttcatttgaagggaaaacaggcttcttgtggctccaggcattttagtaagatatcactgtgacttgtgaaagggtatgtgtaccttcttgtactttcttttaaaaacttttttaaaaatattttttgta

SEQ ID NO: 281337 - DNA, 3947 bp, Homo sapiens
ttattctactcatgctataattatttaccagtaactttggttcttcctgtattccaatttgaataccctatatttctttctcttgcctgattgccctctctcaccactcctattcagcacagagttggaagttctggccagggcagtcaggcaagagaaataaataaagggcattcaaacaggaaaagaggaagtcaaatggcctctgtaagccaaggagcgaggcctctgaagaaaccaaatgggccaatgaaaaaaaagaaaatgtcaggcccatataactgatgaacgtcgatgcaaaaatcctcaataaaatactgcagaccaaatccagcagcacatcaaaaagcttatccaccatgatcaagttggcttcatgcctggggatgcaaggctggttcaacatacgcaaatcaataaatccatcacataaacagagtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281338 - DNA, 2725 bp, Homo sapiens
ggtggcgttcagaggagtcccggaagttcctttcacttcacagacaagggatgttctcaaacagcattttaatgatttaaagggaacccttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281339 - DNA, 3361 bp, Homo sapiens
  misc_feature (2445)..(2445): n is a, c, g, or t
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtaagagataaataactgtcattctcttggaaatatattaattattttagtaatatgtgaatctgttccagttccatacatttatagtaggagatgagaaaatttaggtatttttctttttcttttttttttttttattatgaagtctcactccatcactcaggctggagtacagtggcatgatcgtagcccgctgcagcctgaaattcttgggcccaagccatcctcccaccccagcctcccgagtagccgggaccacaggtgcatgccactgtgactggctaattttttttatttttacttttttgtaaagataagttgttgcccaggtgagtcttgactcctggtttccagcaatcctcccaccttggtggcctcccaaagtgctaggattacaggcgtgagccaccgtgcccagccaacaccacaaaatattattaacatgtcttgctagtgaatttttttttttttttttttttgnaaagggattcccacctggtacctggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281340 - DNA, 2460 bp, Homo sapiens
ttttatatttgaatgttatttagttagtttttttgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281341 - DNA, 2269 bp, Homo sapiens
aattatgcttgtacaatgattttattagataagagataacacttgtgtgatttattatgtcaaaattatgcaggaatatactaaaatcttttgtaatttgtgggactgatcatgataccctgttaatggaatcttttattttattgaacttgaccatggcccctaagagtagtctcccatttccatgttttatttaacgtgtctgtattgaagatatccctcaagagattctaacagttttcaatatctttgctttgaaaaagagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281342 - DNA, 2141 bp, Homo sapiens
  misc_feature (91)..(91): n is a, c, g, or t
ggccggcaccacatggctggctgcacatcagttattcccaggtcattactcagctaacagacgaaaaccagtcatgttgccccgctttgtncatagatttttccagacagaggctgagttacagtatagcaagaactcaatcatggttgctgtactattcagaaaaaaacaattgtggtgagattgctctttttaagctagtggctgttaagtatcattcatgttatatttttaaaagtatgaaatgacctttctacttcatttacagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281343 - DNA, 2851 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactccagcctgggtgagagagcaagaccctgcctcagaaaaaaaaaaa

SEQ ID NO: 281344 - DNA, 1655 bp, Homo sapiens
  misc_feature (7)..(7): n is a, c, g, or t
  misc_feature (10)..(10): n is a, c, g, or t
  misc_feature (14)..(14): n is a, c, g, or t
  misc_feature (739)..(739): n is a, c, g, or t
tcgtcanagnatcncgtggtcgatcactgtactattcagaaaaaaacaattgtggtgagattgctctttttaagctagtggctgttaagtatcattcatgttatatttttaaaagtatgaaatgacctttctacttcatttacagagttgaaactgtgggacagccagacagaagagatagcataggagtgtgtgcagaaaaacaggatggatatgactctctgcagcgggatcaagctgtgtgcattagtacaaatggtaagagataaataactgtcattctcttggaaatatattaattattttagtaatatgtgaatctgttccagttccatacatttatagtaggagatgagaaaatttaggtatttttctttttcttttttttttttttattatgaagtctcactccatcactcaggctggagtacagtggcatgatcgtagcccgctgcagcctgaaattcttgggcccaagccatcctcccaccccagcctcccgagtagccgggaccacaggtgcatgccactgtgactggctaattttttttatttttacttttttgtaaagataagttgttgcccaggtgagtcttgactcctggtttccagcaatcctcccaccttggtggcctcccaaagtgctaggattacaggcgtgagccaccgtgcccagccaacaccacaaaatattattaacatgtcttgctagtgaatttttttttttttttttttttgnaaagggattcccacctggtacctggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281345 - DNA, 1778 bp, Homo sapiens
  misc_feature (91)..(91): n is a, c, g, or t
  misc_feature (862)..(862): n is a, c, g, or t
ggccggcaccacatggctggctgcacatcagttattcccaggtcattactcagctaacagacgaaaaccagtcatgttgccccgctttgtncatagatttttccagacagaggctgagttacagtatagcaagaactcaatcatggttgctgtactattcagaaaaaaacaattgtggtgagattgctctttttaagctagtggctgttaagtatcattcatgttatatttttaaaagtatgaaatgacctttctacttcatttacagagttgaaactgtgggacagccagacagaagagatagcataggagtgtgtgcagaaaaacaggatggatatgactctctgcagcgggatcaagctgtgtgcattagtacaaatggtaagagataaataactgtcattctcttggaaatatattaattattttagtaatatgtgaatctgttccagttccatacatttatagtaggagatgagaaaatttaggtatttttctttttcttttttttttttttattatgaagtctcactccatcactcaggctggagtacagtggcatgatcgtagcccgctgcagcctgaaattcttgggcccaagccatcctcccaccccagcctcccgagtagccgggaccacaggtgcatgccactgtgactggctaattttttttatttttacttttttgtaaagataagttgttgcccaggtgagtcttgactcctggtttccagcaatcctcccaccttggtggcctcccaaagtgctaggattacaggcgtgagccaccgtgcccagccaacaccacaaaatattattaacatgtcttgctagtgaatttttttttttttttttttttgnaaagggattcccacctggtacctggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281346 - DNA, 2502 bp, Homo sapiens
  misc_feature (2445)..(2445): n is a, c, g, or t
  misc_feature (2472)..(2472): n is a, c, g, or t
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtaagagataaataactgtcattctcttggaaatatattaattattttagtaatatgtgaatctgttccagttccatacatttatagtaggagatgagaaaatttaggtatttttctttttcttttttttttttttattatgaagtctcactccatcactcaggctggagtacagtggcatgatcgtagcccgctgcagcctgaaattcttgggcccaagccatcctcccaccccagcctcccgagtagccgggaccacaggtgcatgccactgtgactggctaattttttttatttttacttttttgtaaagataagttgttgcccaggtgagtcttgactcctggtttccagcaatcctcccaccttggtggcctcccaaagtgctaggattacaggcgtgagccaccgtgcccagccaacaccacaaaatattattaacatgtcttgctagtgaatttttttttttttttttttttgnaaagggattcccacctggtacccgggnataacccgggctcatggaaaccccggcccc

SEQ ID NO: 281347 - DNA, 2747 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatggtatgctgctaaccttttctctcctgaagcctaactatatattagaatacctgtattctgtgctaagggcagcacactgacaaccagctattctaagcatagatcctgaattgataagaacaacatgcaccatgtcttttactcagattacctcatgtgatttttgttttcatcagttcttcagagtccaaaaaaaatgctggacaagatttttagcctcattgaaaaccaaagattgaaaatattatgtagggcactgatattcctttttattcttttttttatatttgaatgttatttagttagtttttttgagacaaggtctcactctgtcgcccaggctggtgtgtggtggtgcaatcatgcagcctgacctctagatccttctgcctcagtctcccaagtagctgggaccacctgcatgcacaccacacctggctaattttttatttttttctagagactgggtcttgctatgttgcccaggctggtctcaaattcctgggctcaagcaatcctcttgccttgacctcccaaagtgctgggattacaggcgtgagccactgtgcccagctgatgctgattttccaaactctcaagaaatacctggagagagacattttcttaaaagtctgatgatttgagggccgggcacggtggctcacacttgtaatcccagcactttgggaggctgaggcgggcggatcacgaggtgcaggagatcaagaccatcctggctaacacggtgaaaccccatctctactataaataaaaaaattagccggacatggtggtgggtgtctgtggtcccagctactcgggaggctgaggcaggagaatggcgtgaacccgggaggcagacttttttatatcagactgggaaatacagaacacatggttcaataaagaaaagaagggagccaggtgtggtggctcacgcctctaatcccagcactttgggaagccgaggcaggcggatcacctgaggtcaggagttcgagaccagcctgaccaacatggtgaaacccc

SEQ ID NO: 281348 - DNA, 2452 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcaggcaagtagatattaaaacatctcacctgcctcaggaagcagagtgaagtgcatagagcatacataagctttgaattcaaaacatcctgagtttattccgtcatttataggcagtgttactgtgggaaggcttctttatttcctgtagctgtagttttctcatctgtattcacagggttattacgtagattaactgggaaatgtatataaaatgcttgttatttaatatgtttatatctcttttcctcttggtaagtagaggtaagtagagtatctctcaaaagtcaatcttaggctgggcatagtggttcacacctgtaaccccagcactttggtaggccgaggcaggtggatcacctgaggtcgggagttcgagaccaacctgagcaacatggagaaaccccatctctactaaaaatacaaaatcagccgggcaggtggcacatatgcctgtaatcccagctacttgggaggctgaggcaggagaattgcttgaacccaagaggcagaggttgcagtgagctgagatcatgccactgcactccagcctgggcaacaagagcgaaactctgtctcaaacacacacacaaaattaaaaagta

SEQ ID NO: 281349 - DNA, 2106 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgagacagccagggagtaaacactgttggctctgtgggctgtatggtctctgccataaatagtacagagatgtggctgcgtctagtacaactttttgacacagaaatctgaatgacatatattgttctgtgtcaagaaacttagattttttttttaactatttaaaacgtgtaacctattcttacgctccagaccattgtagacagcagttgcgtatcaccaggttactctgaacagctgcacg

SEQ ID NO: 281350 - DNA, 2277 bp, Homo sapiens
ttttttataaacatgctgttgttattttctaacaggactgtcattccatttttattatttttcctatcagtggacctagttatttccagttttttgctataagtatttttacttgtgtttctttatggacatatgtgaagtttgtaaaatattaatatttacctaggtgtaaaattatgaggtcttcttagagtattggatccatacgctgataggtaataacaaactttccacaagatgattctatcaatttagccttccaaggagtatatgagtttctgttattccatatcttgaccaataattggcattgtgagactttatatttttgcctaaatgtaccttgttgtggttttatttatttgtttgtttttgagacagggtctcactctgtcacccaggctggagtacagtggcacaatcatgtctccagtctcaatctcctgggctcaagtgatcctcccgcctcagcccccaagtaattgggacttcaggcatgtgcttccacagccagctaagttttgtaattctttgcagagatggggttttgctgtgttgcctaggctggcctcaaattcctgggctcaagtgctccacccgcttcggcctctcaaagtgttaggattataggcatgagccatcatgtctggccttgttgtggttttagatcgtatttgccatattacaaattaggtacaaattaggttgaatattcataatatacatttttggctatttatgtttcttctcctgtagaacgcttatttatgtcttttacccatttttctattgggtggctaattaacatacagaatatatgcaggacccctaaaaattaatgggggttctgtatactgtatgttaattatctcttggttattatgaatgatgtatggttgtgggagacttactgaatcttgaatgttttatctttggcattgattaaaaaacatgccatttcttcaaaggaggcagacttttttatatcagactgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgaagaatgagggtcttgctgtgttgtccagactggtctcaaactcctggcctcaagcagtcctccccagccttggccttccaaagtgttaggggttacagagtctcactgtcaccaggctggactgcagtggcacgatctcgactcactgtaaccccgcctcctgatttccaacttgc

SEQ ID NO: 281351 - DNA, 483 bp, Homo sapiens
aatcatgaccttttctacttgtctttttatatataagtagtagatttccacttgtttagggattaagaagatgttctagaatgtagataccttgtccagccataggaatcaaaataaaaaactaaaaaagttcagtgtgtgtacttttttcttctgtgagatttggtgaatccagttttaacctacttttcatttgaagggaaaacaggcttcttgtggctccaggcattttagtaagatatcactgtgacttgtgaaagggtatgtgtaccttcttgtactttcttttaaaaacttttttaaaaatattttttgtagagaatgagggtcttgctgtgttgtccagactggtctcaaactcctggcctcaagcagtcctccccagccttggccttccaaagtgctgggattataggcatgagtgaccacacccagctggttacttgtactttcctatattctgtgtctgatactgagcatctt

SEQ ID NO: 281352 - DNA, 2920 bp, Homo sapiens
ttccgcctgcgcgaggccgcgccgggccgcttggaggcgcccggtgcagtcgggaacccgcgctaggtttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaacccttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 281353 - DNA, 814 bp, Homo sapiens
ttccgcctgcgcgaggccgcgccgggccgcttggaggcgcccggtgcagtcgggaacccgcgctaggtttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaacccttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtatgtaattcagaattctagaaatgacttccacattatgggtttgcgatttggaggcctttcagattttttcgttgactacttttaaatacattcttttcttctcaaacaaaaatctctttt

SEQ ID NO: 281354 - DNA, 7389 bp, Homo sapiens
  misc_feature (1754)..(1754): n is a, c, g, or t
  misc_feature (1811)..(1811): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggccttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 281355 - DNA, 9713 bp, Homo sapiens
  misc_feature (4078)..(4078): n is a, c, g, or t
  misc_feature (4135)..(4135): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggccttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 281356 - DNA, 9510 bp, Homo sapiens
  misc_feature (4078)..(4078): n is a, c, g, or t
  misc_feature (4135)..(4135): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggccttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 281357 - DNA, 5767 bp, Homo sapiens
  misc_feature (4078)..(4078): n is a, c, g, or t
  misc_feature (4135)..(4135): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggttgcagtgagcggggattgcaccattgcactcgagcctgggcaacagagcgagactccgtctcaa

SEQ ID NO: 281358 - DNA, 4918 bp, Homo sapiens
  misc_feature (4078)..(4078): n is a, c, g, or t
  misc_feature (4135)..(4135): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaaccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 281359 - DNA, 9653 bp, Homo sapiens
  misc_feature (4078)..(4078): n is a, c, g, or t
  misc_feature (4135)..(4135): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggccttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaatttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 281360 - DNA, 8221 bp, Homo sapiens
  misc_feature (4078)..(4078): n is a, c, g, or t
  misc_feature (4135)..(4135): n is a, c, g, or t
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaanttttatgtctttgttggtgggcatcacttcaggcatgtggatttggtctgccaaaantcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggccttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctactcaggaggctgaggcaggagaatggcgtgaacctgggaggcagagcttgcagtgagccgagattgcgccactgcactccagcctgggcgacagaggagactgtgtctcaaaaaaaaaa

SEQ ID NO: 281361 - DNA, 2969 bp, Homo sapiens
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcaggtgggcgcccccacccccacccctggcgggaccccttggggagggacgctccaaactaactttgcagagcccatgccaagttgatcatcctagcccgaaggagacagctctcctggaaaagtgatttccatccccacccccactttctcagggactggaagccaaaacgttgtgtaagtcatctggcctgggaaagaacccactcttacaccccgcccttccgtttttctctcttgcccacccatgtctggcccagacccctaaccccagtggagctgagggttatctctgccaaggattctggccgccactgctcggtgggcgagtgggagggagccagctgcagctaagacttggagggagtgataaggagaccatccttcaccgaacttccttctccccactatttttggggtgttattaaatgaaacactactgcacctttttctgctgaatagccccttctcacgacgtcccgcagcgttttagaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtaaagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttagaaaagagagaagttgtgggaaaaagtagacgttagttgtccaggcttcagaaatctggtttctggccgggcgcagtggctcacgcctgtaatcccagcactttgggaggccgaggcaggtggctcacgaggttaggagttcgagaccagcctgaccaacatggcgaaatcctgtctctactaaaagtacaaaaattagccgggcgtggtggcgtgcgcctgtaatcccagctactcaggaggctgaggcaggagaatcgcttgaacccaggaggcagaggttgcagtgagcggggattgcaccattgcactctagcctgggccacaggagcgaaactccgtatcaaaaaaaaaaagaaaagaaaagaaatctgtggttctggctgtaacttctgagagataataaacagacatacagcttacttactaggtgcatgtttttacataggtcattttaaaacttggtttgtggttttggaaagatggtggggattagacctgttgctgctaaaatatccctttggaagtttcagaactttagaactaggttataaaagcttaagaaatgatcctccagctctcagtttggaaacagcacatatcctgacatcagtggcaatttgttggagaaacagcttttgcagggatatatatttttaattacatgtatcctggggaaagcggccaagctgttttgaaggacaagactggatccctttacatgctggaaaatagttacttgtaactctagacttcatagacaacatctgtaaggagccaagcagactgtttatcaatgctggaggaattgaggacagcaactggactctcccctgctggtactgcagtttcagcgacttaacatttacattttcctattgtgcttcattattattcattgaggaaacctggccaaacaaatccctagtgaccagagacctcaatctgcatcccatccttgagtctaacagtgtctcatttgggccattttttgtttcagtatgggactagtttaaacaaatttttaagggataaattagggagaagagaatactaacaggatctacatttttttttaacttttatttttaaaatgataaagaaacggggataaaaataaaccacctaaatgagtcatattagtttctttagctttttcaaatagtttctaaaatggaaggagattgaaagccagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttaaaccttttttttttttccccccctaaaggggggggccttacaccattttttttccct

SEQ ID NO: 281362 - DNA, 391 bp, Homo sapiens
gatccccgggctgcaggaattcggcacgagcttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaacta

SEQ ID NO: 281363 - DNA, 1167 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgaccctgtgctgcgctctgtgctgcagtgtgctgtgctgtgctgcactcacttctgtgcatacctcctcgtgcaatatgctctgctgtgcactgtatgcccactgtgcatgtgatgtgtagcccctcatgccacccctgtgttgtgtggacatgtgcatgctgtgctgtgctttgtgtctgactgaactgcctgtggcatttctgtgctgtgcccgctgtgcttgcatcccctttcacctgtgccctctgattttccctgtgacttaagtgtgcaatgctgctggtgatccctgcagttgatgccccctgtgtctgtgttggctgtgcatgctgaaaatgatgaaactgactgtggctgtgttgtgctgtggcctgtgatggtgcggccgtggctgaaggggccgacttaccgaacccatgcttgatgagctgtgccgcacgaagcccccagtgcgcaggtgtgagctgaacagaacgcaggctttaaacaaaattctgtaaacgcagcccttgacttttatagggaaatttcacacaagactccctcagacagttagggccgcaaacatactgagctaatttaaaggccttacgctcccag

SEQ ID NO: 281364 - DNA, 10297 bp, Homo sapiens
  misc_feature (6298)..(6298): n is a, c, g, or t
  misc_feature (9478)..(9478): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281365 - DNA, 10184 bp, Homo sapiens
  misc_feature (6185)..(6185): n is a, c, g, or t
  misc_feature (9365)..(9365): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281366 - DNA, 10124 bp, Homo sapiens
  misc_feature (6125)..(6125): n is a, c, g, or t
  misc_feature (9305)..(9305): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaactcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281367 - DNA, 10243 bp, Homo sapiens
  misc_feature (6244)..(6244): n is a, c, g, or t
  misc_feature (9424)..(9424): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacatttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281368 - DNA, 5868 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 281369 - DNA, 9988 bp, Homo sapiens
  misc_feature (5989)..(5989): n is a, c, g, or t
  misc_feature (9169)..(9169): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281370 - DNA, 10563 bp, Homo sapiens
  misc_feature (6564)..(6564): n is a, c, g, or t
  misc_feature (9744)..(9744): n is a, c, g, or t
aataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggacttttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281371 - DNA, 5347 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaacta

SEQ ID NO: 281372 - DNA, 9804 bp, Homo sapiens
  misc_feature (5805)..(5805): n is a, c, g, or t
  misc_feature (8985)..(8985): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281373 - DNA, 9384 bp, Homo sapiens
  misc_feature (5385)..(5385): n is a, c, g, or t
  misc_feature (8565)..(8565): n is a, c, g, or t
tgcgcagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281374 - DNA, 4654 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaaggagtgtagcgacaagcttcttctcttcttttttaatattcttggcgcatttaccta

SEQ ID NO: 281375 - DNA, 9832 bp, Homo sapiens
  misc_feature (5833)..(5833): n is a, c, g, or t
  misc_feature (9013)..(9013): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaagaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281376 - DNA, 7712 bp, Homo sapiens
  misc_feature (3713)..(3713): n is a, c, g, or t
  misc_feature (6893)..(6893): n is a, c, g, or t
tagaggatcctcaactacacagctatccaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281377 - DNA, 9806 bp, Homo sapiens
  misc_feature (5807)..(5807): n is a, c, g, or t
  misc_feature (8987)..(8987): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281378 - DNA, 7434 bp, Homo sapiens
  misc_feature (3435)..(3435): n is a, c, g, or t
  misc_feature (6615)..(6615): n is a, c, g, or t
gccaccaaattacttactactttattcctttggcttcataaaattacatatcaccattcaccccaatttatagcagatatatgtggacattgttttctcaagtgctaatataatagaaatcaatgttgcatgcctaattacatatattttaaatgttttatatgcataattattttaagtttatatttgtattattcatcagtccttaataaaatacaaaagtaatgtatttttaaaaatcatttcttataggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281379 - DNA, 7555 bp, Homo sapiens
  misc_feature (3556)..(3556): n is a, c, g, or t
  misc_feature (6736)..(6736): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaaggtaagatgttttattttcaaagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281380 - DNA, 6648 bp, Homo sapiens
  misc_feature (2649)..(2649): n is a, c, g, or t
  misc_feature (5829)..(5829): n is a, c, g, or t
catatagagagattcgtcctccgctacatcaaaatgagctgcgtgacctcttattaaaaccgctcagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281381 - DNA, 2865 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccgggtaagttgggctgctagattaaaacctaataatggggatatcatgatacagttcagtgaattcattttaaaagtgactgaaaaaaatgataccatatagcataggaacacatggacatttctgatcttatataagtattatacttttgttgttcctgtgcaagtttatagatgtgttctacaaagtatcggttgtattatataa

SEQ ID NO: 281382 - DNA, 2175 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctacctgggttaggtctacctggccaggtagacctaacagcagcaacaaacagcagcaacagcagcacagtaaaggcaatacaatttcctgctttcaccaattaaccactgaattgctatttttttccttttggccagatagctaggtttctggttcccccacagtaggtctagttagtctacctg

SEQ ID NO: 281383 - DNA, 1564 bp, Homo sapiens
  misc_feature (1538)..(1538): n is a, c, g, or t
  misc_feature (1559)..(1559): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgtcgtcgccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagntttgtgcttcctgtccaactnttctt

SEQ ID NO: 281384 - DNA, 460 bp, Homo sapiens
ctcccctccgtcactcggccggccttcggggcccgctgtggcgaggtcgacaccccccttccccgccccccgccgccgaggcgagtgtttgggggcgcgtggtccgaaggggctggtgcgcagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggtgggttggggttttgggggtggattgatgggaagggagggcggatgaagtggtatgtc

SEQ ID NO: 281385 - DNA, 435 bp, Homo sapiens
tcctctctgtggttttgttgtggaaagatttagttaaatgaactgtaagaattcagtacctaaaatggtatctgttatgtagtaaaaactcaatggatacagtatcttatcatcgtcactagctttgagtaatttataggataaaggcaacttggtagttacacaacaaaaagtttatgatttgcattaatgtatagtttgcattgcagaccgtctcaactatatacaatctaaaaataggagcatttaattctaagtgtatttcccatgacttacagttttcctgtttttttccccttttctctatttaggttacctacatctcatacttgctttaatgtgcttttacttccggaatactcaagcaaagaaaaacttaaagagagattgttgaaggccatcacgtatgccaaaggatttggcatgctgtaaaac

SEQ ID NO: 281386 - DNA, 756 bp, Homo sapiens
ggaaatgtagccattttttgtttttttatgtttatttttcagctatgggtggataaagcatgaatataacttttcttatgtgttagtagaaaattagaaagcttgaatttaattaacgtatttttctacccgatgccaccaaattacttactactttattcctttggcttcataaaattacatatcaccattcaccccaatttatagcagatatatgtggacattgttttctcaagtgctaatataatagaaatcaatgttgcatgcctaattacatatattttaaatgttttatatgcataattattttaagtttatatttgtattattcatcagtccttaataaaatacaaaagtaatgtatttttaaaaatcatttcttataggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagtaagttctttgtcatttttttaattcagtctcttagattttatttaaatgcaaaaatttaatttatgtcaaaattttaaagtttttgtttagaatctttgttgatactcttatcaataagataaaaatgttttaatctgaccgaagtaccagaaacacttaaa

SEQ ID NO: 281387 - DNA, 5246 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccaacgagccacaacaaagcgccccgcaatgggccacccaatgagccccctaagcgccacgcgaacgagccccacaaagagccaccatgagct

SEQ ID NO: 281388 - DNA, 7076 bp, Homo sapiens
  misc_feature (3077)..(3077): n is a, c, g, or t
  misc_feature (6257)..(6257): n is a, c, g, or t
attgataagatttttgttgtcttctaagaagagtgatataaattatttgttgtattttgtagttctatggtggcctcaatttaccatttctggttgctaggttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281389 - DNA, 3476 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagctctgggaagtcgttcagtcaatagcagttgaccagtgtagactcacggccagggaatccgctag

SEQ ID NO: 281390 - DNA, 1793 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaaggtaagatgttttattttcaattgagaattgttgcctgaaaaccatgtgggagatttaaatgtattagtttttatttgttttttcttctgtgacataaagacattttgatatcgtagaaccaattttttattgtggtaacggacaggaataataactacattttacaggtctaatcattgctaattagaagcagatcatatgccaaaagttcatttgttaatagattgatttgaactttttaaaattcttaggaaaaatgtattaagtggtagtgaatctccaaaactaggccacaacatctatttaagttataggaataactgggactaagtatctgggcctgagttctggaacctcaggatgatgtgatgaaagaagc

SEQ ID NO: 281391 - DNA, 1255 bp, Homo sapiens
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatggtatgtttttgttttattttttggaattcgtattgcatgtgtatcttaatgtcataataatgacagatgtgttcagcaaatttgggcccctgccatttttaaagcattgtgtcaggtgctcactaactacacttccaagactgtatgagggacccaggtagggtgctgaaaaaatttacaagagattagtgtgctatgagaggtaaaataatatgcataaaaagattgagagggcaggtttggattttgggctatgagtattaataatagctttcatttgttgttgttgttgctgctgctgc

SEQ ID NO: 281392 - DNA, 8635 bp, Homo sapiens
  misc_feature (4636)..(4636): n is a, c, g, or t
  misc_feature (7816)..(7816): n is a, c, g, or t
gtacgggatatcgtcgaccggcgctcgatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281393 - DNA, 9613 bp, Homo sapiens
  misc_feature (5614)..(5614): n is a, c, g, or t
  misc_feature (8794)..(8794): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281394 - DNA, 9833 bp, Homo sapiens
  misc_feature (5834)..(5834): n is a, c, g, or t
  misc_feature (9014)..(9014): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281395 - DNA, 10258 bp, Homo sapiens
  misc_feature (6259)..(6259): n is a, c, g, or t
  misc_feature (9439)..(9439): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctcgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281396 - DNA, 10053 bp, Homo sapiens
  misc_feature (6054)..(6054): n is a, c, g, or t
  misc_feature (9234)..(9234): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281397 - DNA, 11607 bp, Homo sapiens
  misc_feature (7608)..(7608): n is a, c, g, or t
  misc_feature (10788)..(10788): n is a, c, g, or t
aaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggacttttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggattttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattanacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgattgctgtagcttggtagtaagtttagatttgggatgtgcaagtcctccattttttttttttttctccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccantttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttcccagcagggtgtattccccaggaaagaaagtcattcccccacccctggctcaaagtaataattaacagtgactgggtaaggcaggatctttttttcctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaa

SEQ ID NO: 281398 - DNA, 981 bp, Homo sapiens
  misc_feature (798)..(798): n is a, c, g, or t
cagggaaggagaacttaggctaggtacgaggcctgggtgttgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgtgggtccaaaagcggaagatccatacccaccanaaccccttacgtggtttttctgctgaggtccgccccactaccacctcaaggtggggtctggattggttcccctcatgaccaagtctccagtgccctgtttccttggggctaaccaatacctttggccaggcagcacggagtacgaagattccggaacccgcctggatggcttatccttttgtt

SEQ ID NO: 281399 - DNA, 581 bp, Homo sapiens
  misc_feature (3)..(3): n is a, c, g, or t
  misc_feature (107)..(107): n is a, c, g, or t
  misc_feature (177)..(177): n is a, c, g, or t
canacattttcttgatctagaagaaaaaggaatccacaggctctaatcaaacacagggtatgtccaatacagtcaaaagtcacctttcacaaagcaaagccagtgantattgtccagaaagaactcaagtctccgggtttttcctttttttttttttttttttttttttttaagttncaggatacaagtgcagaacgtgcaggtttgttacataggtataagtgtgccatggtggtttactgcacctaacaatccgtcacctaggttttaagccctgcatatattagctatttgtcctgatgtttttcctctccttgctgcccccgcaacccaataggccccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281400 - DNA, 199 bp, Homo sapiens
gcggccgcctactactactactactgctcgaattcaagcttctaacgatgtacggggacgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281401 - DNA, 544 bp, Homo sapiens
gcagactctctctcgagcttcccttacagggggaaacagcttggaagccatgggggaggaacttttttgtctgtcaggggagagcaaggaagaaccccaagtttctacctctcactgccaacagcagagacgcccccctaccaacagtatttccgcgtagcctgacagtggaaaaggactcatgcggttaggtgttcacctccaggtgccacctaggccctgccactcctggactgacccatcctcctggcaacatcaccaagagatggctaaagacacatggtccagggtcggctttcggtaagtgtttactctcaacgttttagggctaatggtgcgtaggaagagaagaaaaaaaaaaacaaaaataaatagggagtttttaaatcctcacacattagcattcactgccaccatccttgcacaaaaagtcagctccagatcaagcccagaagccagcctgaatcatcaacgggcacaggaacaaaaagccctgctctccttaccctccgaggcggccccgctctccggacctgggcggccg

SEQ ID NO: 281402 - DNA, 1402 bp, Homo sapiens
agcgggggggcggggcggacgcagagccgcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggaaaaaaacaaccaacagcacacgacaccacacaacagcaaacagcagggggcgggcaacatcacccacgaggacacactacaccccactgtgaagacgccccacaaggacgcaataaagccggcggcgcctaaacacgacagcacaaccgtcattgtcgacccccttgtctaagaaccaccaaactcacaaaacaatagcgagctcacgatcatacagactaacagcgacagcc

SEQ ID NO: 281403 - DNA, 1201 bp, Homo sapiens
agcgggggggcggggcggacgcagagccgcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaagagctgacgtccctgcgcctgtgcttcccccaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281404 - DNA, 369 bp, Homo sapiens
gtgctggattctgaaggagttccgggactacccgccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281405 - DNA, 1136 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281406 - DNA, 1369 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggaaaaaaacaaccaacagcacacgacaccacacaacagcaaacagcagggggcgggcaacatcacccacgaggacacactacaccccactgtgaagacgccccacaaggacgcaataaagccggcggcgcctaaacacgacagcacaaccgtcattgtcgacccccttgtctaagaaccaccaaactcacaaaacaatagcgagctcacgatcatacagactaacagcgacagcc

SEQ ID NO: 281407 - DNA, 1302 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggaaaaaaaaaacatcaccaccaccccccacacacccacacaccccaccccaacacacccccgctctacttccgccggcaaaaaaccacaaacgcgccgccacacctcccaccccctttccaagggcactcccgcccccaagggcgcaaccgacacgcgctccccccac

SEQ ID NO: 281408 - DNA, 1175 bp, Homo sapiens
  misc_feature (13)..(13): n is a, c, g, or t
  misc_feature (1140)..(1140): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggagaanaaaacaaccacacaagacgcacagaccatgccaat

SEQ ID NO: 281409 - DNA, 1169 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggaattttacaccaaccccacggtgcgttggcccaa

SEQ ID NO: 281410 - DNA, 1093 bp, Homo sapiens
actttcttcgcatcatattctctcatgaagcattacgaaggtggagattctggacgcaaagacaagggagaagctgtgtttcttggacaagagctgacgtccctgcgcctgtgcttcccccaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281411 - DNA, 990 bp, Homo sapiens
cccgccgtaccagttggcgcccgcccgcccgccgtacagttgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281412 - DNA, 956 bp, Homo sapiens
  misc_feature (26)..(26): n is a, c, g, or t
  misc_feature (28)..(28): n is a, c, g, or t
tgaggtgactctaccggatccttacncntcactaagacatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281413 - DNA, 1032 bp, Homo sapiens
ccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccatctcgtctcttctctttacaagagaagagacgagatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281414 - DNA, 1220 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcagtaagtggggcaggtgggaggagggtaggggaaggcagaagacctgccggaccagccccagctgagcctgctccccccgaccagcctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281415 - DNA, 1235 bp, Homo sapiens
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtgagtgcctaggtggctgggggcagggggacagctgggctgggtgagggggtctgactttctccttctgtcctgcctgccagggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281416 - DNA, 693 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaagcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281417 - DNA, 1093 bp, Homo sapiens
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281418 - DNA, 612 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagcggggggatcctcatagaacaga

SEQ ID NO: 281419 - DNA, 914 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtaagaagcgagaaacaggggccgtgtggccactgctgacccattctttttccttctttgcgggaccacgggaccccactttctggtcctgtgccccgaaggaagagccagacggcgcaggcgcagtgggcaagcgttgcgccccgggccactcgtaaattccaatgcgcatgtgcgcaggaagtatttataaatctgcaacccaggctgttttgggggtactttttcttgggggtctctgcaggggctgggacgcttgcaggttccttgcagctcccccagcgggctgagttgcagactttgtcatgggagccacgaaggtgcgggacccttgctcccaatccgagggagtcttgcacaaatcttgcgccacgccgccgtcaccagcgtaggaaggggctttgctatcagtattcttgtgtacgacctttggaccccttccctcgcccgggacgttcccgggagacttaggcggtgagggaggtgcagctccacggctggctttcgcagagcggcgaagctgatcttgccttctggttatcaaagaggtcatctacgtcaacccttgggtgtcaccaaggagaaatcttatacccacccacagccactcttgaagcccaagtcttctgactcctaacttgggtctctttttcccttaaaacgaagtcttctgatgtgcttatcgccctaggtgataatataatattaataattcaaccaattatccctgaattattgctgacttttaagtaactatcatcaaataataaaatttgttattaaaatcaaaataacaatt

SEQ ID NO: 281420 - DNA, 562 bp, Homo sapiens
  misc_feature (13)..(13): n is a, c, g, or t
  misc_feature (545)..(545): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccacagctctccagcacccggaataaagcccgcctgcnccagtcggaaaaaaaaa

SEQ ID NO: 281421 - DNA, 278 bp, Homo sapiens
  misc_feature (36)..(36): n is a, c, g, or t
  misc_feature (39)..(39): n is a, c, g, or t
  misc_feature (252)..(252): n is a, c, g, or t
  misc_feature (278)..(278): n is a, c, g, or t
ggagggggacggagcggtaatggatagggggaaaangancttcaggtgacgtgactctctttttaaccccgatcaggtggagattctggacgcaaagacaagggagaagctgtgtttcttggacaaggtggagccccacgccaccattgcggagatcaagaacctcttcactaagacccgtgggaggagctgtggagtcctggggtccttgcaccctgggaaccctgagaagctggcacagctctccagcanccggaataaaacccgtatcggcaagn

SEQ ID NO: 281422 - DNA, 705 bp, Homo sapiens
  misc_feature (688)..(688): n is a, c, g, or t
tggtgcggcgttctagaggatccgatgtgagtgtgatatgtatttggcagcaggtgacacattttagggtcacagggaaaaacactcctttctttagactcacacgtgttgtgccctgtcagtgtttggtcatgatatgggaaataggcttccatagaaatgattggaagcacatgtaatcgccctttatttattaaagaatcttactcctttggtgttcctaaactttgaagctcacgttggggaagttgaaaataagagtgtggggattataggtgcaagccaccatgcccagccaaacaattattaaatataaatggttatatgtaaacaatcacatcatgcatgatgtgattgttccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccacagctctccagcacccggaataaagcccgcctgcnccagtcggaaaaaaaaa

SEQ ID NO: 281423 - DNA, 1169 bp, Homo sapiens
agcgggggggcggggcggacgcagagccgcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281424 - DNA, 241 bp, Homo sapiens
ctggtgtatggtgactgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtcccgtgaaggcgcttgatgtcagtggaatggggtcaccgc

SEQ ID NO: 281425 - DNA, 1151 bp, Homo sapiens
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281426 - DNA, 1671 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggaaaaaaaaaaaaaaaaaaaaaaaaaaaaaagaaaaaaaaaaaaacaaaaaaaaaaaaaaaaaaaaaaaaaaaaaaaaaaaaaaaaaaaaaaaaaacaacaagcagggatttttttgtgttttttttttttgcggggggggggggggccccctctcgccaggataccctatgtcgcaggcgcgcggtggcacgcactaacctacccattatcacactgacaattcgccaccgagatacgtggccgatgagacaatatccactactagaccggaggcgaatcgaccgaggtgcccccgccccaccacacgcccgcgagaactgcgcgccaacgacaaccaataaaccacacaagcccgggccgagaacaccacgctcggcggccacgaccaccaaaaacaggacgtgcccgacacacagcgcagcacgaacgaccaacacctcagtgccgcacaacaaagacgaccgcggcgcagggcggggatatcaaacaacaaacgtgacgagacgggacacaaacactaacacacgcaccacgc

SEQ ID NO: 281427 - DNA, 1097 bp, Homo sapiens
  misc_feature (36)..(36): n is a, c, g, or t
  misc_feature (39)..(39): n is a, c, g, or t
ggagggggacggagcggtaatggatagggggaaaangancttcaggtgacgtgactctctttttaaccccgatcaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281428 - DNA, 1094 bp, Homo sapiens
  misc_feature (1047)..(1047): n is a, c, g, or t
  misc_feature (1049)..(1049): n is a, c, g, or t
  misc_feature (1052)..(1052): n is a, c, g, or t
  misc_feature (1054)..(1054): n is a, c, g, or t
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgccccttggatgcaatatcctctgttgaggtacctgtgagtnanctnancggggtcgggagaggggccaggttcgacgaaagcgtgccg

SEQ ID NO: 281429 - DNA, 1072 bp, Homo sapiens
  misc_feature (22)..(24): n is a, c, g, or t
  misc_feature (27)..(28): n is a, c, g, or t
tccggaggatgtgttgggcaannnaanntttgcaacccacagccccctcaggaggaaccatctggccgcattgaaagggagaagctgtgtctcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281430 - DNA, 1233 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccagtgagtacagctgtccactcggcccgccccctgggctcctgggtggcagtgggagaaggcccgggtagcccctgagccctggcccgcctctctgcagagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281431 - DNA, 1241 bp, Homo sapiens
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctagtaagtggcctcagaccatccttccctcccccacggtccccacccagcgggtcctcccctcatgggctcccctccctgcttcctcttcagcctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281432 - DNA, 1105 bp, Homo sapiens
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281433 - DNA, 1107 bp, Homo sapiens
attagaaggggctggggcctcggccgagggcggcttgggatcctgtgctgaggggactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctaatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281434 - DNA, 1304 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcagtaagtggggcaggtgggaggagggtaggggaaggcagaagacctgccggaccagccccagctgagcctgctccccccgaccagcctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtgagtgcctaggtggctgggggcagggggacagctgggctgggtgagggggtctgactttctccttctgtcctgcctgccagggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 281435 - DNA, 505 bp, Homo sapiens
  misc_feature (13)..(13): n is a, c, g, or t
aaaaaaaagaagntgtaccgtccgaatcccggatgggtgtactgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctcttgtatacaagagagagacgagatgatatcatttacgggggaaggcgctttgtgaagtagccttatttctcttgtcctttcatacagt

SEQ ID NO: 281436 - DNA, 3252 bp, Homo sapiens
gcacatggaagtgcctcggacctggagtactggatagggagcaggactggagattggacgatgaagggctcggtttgggacgcacggagtgtgaggcttctttgggtcaccacagcagaagtattctcctggaaaatattcagagggcagtggaatgaagcttggggcccgggaggcaggcatcggctcccagacaccagctgaagccaaggtgacagtgagagcgtcaccttccctggggagtaagtacagcatccacgtctggacacacgggtctttagatcgcagagtgagccacacattctctgctgcctggacaggccctcccaggctgtcaaggccattggccctggccaggtacccctgcagggctacagaccgctctggagtgttagatgagctatttgggaagaaatggcaaaagagatgtgaaggggaaacagatgaagaagagcaaagtgccaagaataagatctctaagttggtggaggaggtgaagtatttctcaaaattccacacaccccttgtgaagttgccatagagccacttccctctgcttttacaaaggctgttgagtctctatggcaattcctttacttcatccttcattcctttcttgcgtgagtagtgaaccgttgaagacacagctgtacccattgtgaaccacagagacagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagatagaaacatacagtttcctaaagcctggctttgaatgcagaagggagcagctcctcctagttaagtttccactaaatcatcgccaaagaggacttcacagccctggggaggcagctgagggtctcaagggtgactgggtggcacggatgaatgcggtgggtgagaatcccggtgccctgagaggctatacgtgacaaatgaccaaaagcccaacgtaggggagtttcctctgctcacagttcttaccttcaaggcggatctgggcttccaccctcatgaacacagggattggggagggaccagagcgcccaatacacacagctccattatgcaatccattccagcaaattcccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgcttagattgggaggcctcattggcacttagagcgcacgctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaaccccagcatctttctagtccctatgctgtatgcttgaacttcggaaaatgctttttccccgcccaatcttctcttcaaatataaacacatcacaacagggtgttgggggtggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtgtacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagta

SEQ ID NO: 281437 - DNA, 2776 bp, Homo sapiens
gaggacgaggggaagatgtcacgcaagatagaaggctttttgttattacttctctttggctatgaagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagatagaaacatacagtttcctaaagcctggctttgaatgcagaagggagcagctcctcctagttaagtttccactaaatcatcgccaaagaggacttcacagccctggggaggcagctgagggtctcaagggtgactgggtggcacggatgaatgcggtgggtgagaatcccggtgccctgagaggctatacgtgacaaatgaccaaaagcccaacgtaggggagtttcctctgctcacagttcttaccttcaaggcggatctgggcttccaccctcatgaacacagggattggggagggaccagagcgcccaatacacacagctccattatgcaatccattccagcaaattcccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgcttagattgggaggcctcattggcacttagagcgcacgctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaaccccagcatctttctagtccctatgctgtatgcttgaacttcggaaaatgctttttccccgcccaatcttctcttcaaatataaacacatcacaacagggtgttgggggtggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtgtacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagta

SEQ ID NO: 281438 - DNA, 481 bp, Homo sapiens
tctggacacacgggtctttagatcgcagagtgagccacacattctctgctgcctggacaggccctcccaggctgtcaaggccattggccctggccaggtacccctgcagggctacagaccgctctggagtgttagatgagctatttgggaagaaatggcaaaagagatgtgaaggggaaacagatgaagaagagcaaagtgccaagaataaggtgactgggagaggtggcactggctttttcccttcccctctgcctactctctcagagctagtagccctgagcggggcggcggcggcgggtgggggtggaaaacaaaaaggaggttcagtcatcaaatgctcaaagtggaggggcctcagagacacccaaggttagaattttgcccatgaaaaatccctgccacctggccttgtgcccctccccctgatcgctcgggcttgtcttcccagctggaggggtgtcgcgggtgggggaggagc

SEQ ID NO: 281439 - DNA, 332 bp, Homo sapiens
agaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagaaagtagaacggcaggcagagttaaaacggaaatttgaacagttgaaacaggagagaattagtcgatatcagggggtgaatctctacattaagaacttggatgacactattgatgatgagggtgtaaattgtattgaaaaagatcgcgaataaaaatcaacaaatgtga

SEQ ID NO: 281440 - DNA, 3099 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281441 - DNA, 2829 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccggggaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281442 - DNA, 2360 bp, Homo sapiens
aatttattgacataaaggacagcgctgtggtgaattcagttcacgagggcgcggccagatagtgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281443 - DNA, 3060 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281444 - DNA, 4296 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggtgaggttcaccagacagaatgcttaaaaggatttcccccatttccacttgatgtaaaagaagctgtgcttttgattccttcaacaggtattaaatgcctgctctgtgttatgacgctatgttctgattcactgtccctgcccttcaggggctcactagtgggaaagaaggggcttaaaagtgctctgcctgatgccagttcactcagaaatgcctcagagcgggcagccagtgcttcctcttctgtttgtacgaaataatgtgctcattcagctgtttgagcctccaggtcacttccgcatccaatgacctattggatccttggctgctctgcaagatgattggtacattaatgcaggaaataacttcaacttacagatcggatgttcagcttcaaagatgtaaagtgtgtgtaggaggtgaaggggttgaacctagagcttagattttctaagctgtaacttgctgtctctagacctgtgctctagatgcaactagtttgtttcagagcctaatagcaatttgctgtggaggtgtcaccctaagccttcaggcccataagctgcttaggagattactctttaactgtcctgtctcatactctctaagttggggatttcctagaacttgatgctatgtaaaataccttttctttgcaaggctttgactagcattgacgttgcatgttgaccgtttttaagcatttgatacaaaaacatttggtagaattaaggtgatgtggaatgtaattataaatgtgttgatatttactccctttgatccaatctgcactgagatttaccctaaaggaaaactaattttcaggaaaaggttatatacaagtgtttacccttatttatatcaaggcttttcattcttgagtaactttgggtgtattaaggaaatgtcagaaaatgcttgcctagcactataggtttgttttattatttacgtttcacttcgctttctgatagcatgccattttcattgtaattggttgtgtttatgtccataccactctgttcctcaacacacccctcaatccttcaaggactgaaattagttcctttagagcaaggacagccacctcctctcctctttcacatagtcagatgttcagatattgaacaggcactcaaccaccatcaggtgttgtcctttcctcagtgctaacccactgcctttcctggttcccaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281445 - DNA, 3012 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281446 - DNA, 3093 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaaccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281447 - DNA, 1975 bp, Homo sapiens
taggtacgaggccctgggggtgactttttctgctttggaaaccatactgttcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281448 - DNA, 3170 bp, Homo sapiens
  misc_feature (13)..(13): n is a, c, g, or t
  misc_feature (1862)..(1862): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaagaatgctggacggagtggtaacgtaaggcacacaggggttttggacnttctgttcttgcatgtcatccattcatctctagaagcaagctaacgctagagatgcaagtacaactgacgatgacatggacagcattagtgggcatccgagagcgcatcgtactattgtagcaccatggggctccaagaggcaacgggaagaagagaagaggctcgaccgtgtacacaaatccgacgtataatgcgaactgagttggcctcggacaatgaggagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281449 - DNA, 1825 bp, Homo sapiens
atgatgctgtggtactgccaggggacagtgttgtgtctgtggagcctgggctgctgcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281450 - DNA, 3662 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgtatgtgtggctattttcatttttgttcctatgagcattgttcctatgagcattgtctttgtggtttgacctgaggttgtatatatgctcactgcttagctctgggaatacaataagtacagttagttacacggagtgtgttgcaggtgacttcttatcatgaggactgtggactttgtctgcaggagcttgagtgaataataaaactagtactggttgatggttgtaggtgtctccagatagggaaagaagagacagtaaaataagctaaggaaaaagcacatggtaaggaccagagctggtgtgttgggagggttgacttggcatagtcatgaccctcttgtcaagggcctcaggagccttgtcatctagtggtaaagaccagagatgctgctaaatgttgtacagtacacaggaggacagacccaacagaatgtccaaagtgtcaatagcactgaggttgagaaactctcttctagaataccttcctttatccactatatgttaatgaatctaaattatttgattatgcatttatttgtgttggtgcttttctttacagggattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281451 - DNA, 3051 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281452 - DNA, 3554 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaaaaaaaaaaaaaaaaaaaaaaaaaaaaaaaaaaaaaaaaaaaaaaaaaaaaaaaaaaaaaaaaaaaaaaaaaaaaaaagggggggggggggaaaaaccggggggggaatgcccacgttttgtaagaaacagagggggcccccaagtagtggaggggagttattataaatcacagaggggagcgggcgcgaagttataaaaacaacaggtgtgagggagggaaaacaaacgccgttgtgcggaggatatcttttttgggagaaagaaagccaccactcatgtgtggggggagggaggaaacaataattggggaacaacaccctacacgcagaagatgattttacgcgcccccgggcgggcaaataataaaataaacgcgtggggggtttattatgtagtggtgcacccacacagcgtgtgattattgttgtgtgcggtagcataaaagattttgtgctgcacgacggcgatgtgatatatgaagaaaactaattttaccaggggg

SEQ ID NO: 281453 - DNA, 2608 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcattgttcccactcatccgaagcagtcgcaagggatcctgtaa

SEQ ID NO: 281454 - DNA, 2885 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggtgagcaaactggcctttagaagtgtggcctggggaggagggagtcaggatgactaggctctgtcctgggttggtcagtttgttgggctcgaatttatcgagtcctggttctgtaatcttagctgtgtgcttaggtggccacttcaggagcagagaaacagtatgagttctaggtgtgtcagttgcttttaacattctttgctcatcggtgacctatgtgaaaaaggttagttgtagaagtttgctagctggatgaccacagaggcagcttgttcttttgggtggggtgaggaatacaaggaaacagtgtatacagaatatgtcttgtattccaagatgtggaaagagttgtatgttatcctttggctcatcctcgaaagtagtagtggccccctgtgcaatgtgttgcgtaaacgtgctttgaaatttctccttccgtgggacgtggccagttggacatctgccgccaacactgatgtgcatttgctggtctgttgtagggtctgagtgcccggaccgcttggctatggactttggtggtgtggactcaggtggtgtggactcaggtgattggactcaggtggtgtg

SEQ ID NO: 281455 - DNA, 2369 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtattatactgcgatctggggattgaaagcagtggtattccattataggcttattggcatttgtcccattgaaggaatagcatttaaattatgttcatttctgaaagtagctactacgtttttctagcaaaatttctggatgcattctggagaatgacatttcattaggttaacattacactgtttcccaagcactggagtctggagaggaatttgacccagcccctccttgccaactcagagcacctgaatctttcccattccttgctgcctcgtgccggtgtggggacagatggtgctacagaatgagcagaggaaatccagacaggttgttttccatttgtcttggggcctgtctctacagctctgccacattttctccttgagaatgaaggtattttgaagattttggaggtgggcttgggaacttctaccctggtcttaaaaagagaggaaaggggagtggaaggtttttctatgtttcgtagtgtgcatcatttgcttgattttctttgataatcatatcaactaagttagcagggtaagtaggaac

SEQ ID NO: 281456 - DNA, 1682 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggtgagtataccacaaagattgggaaaagcttttaagaggttgccccagagtatgggtagggtcttgctagcacctacctagagctgggacggtctgagta

SEQ ID NO: 281457 - DNA, 1330 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaagtggtgtgttatgagaaccgctctaagggtatagccttcgtccacactcggacccaaggagtcgccgacaggcatagcgatagtagatggatactcctca

SEQ ID NO: 281458 - DNA, 285 bp, Homo sapiens
gtgagatgagatgagatacttctctaggatgggttcagtccttaagggggtgtttgggtattcttctgtcttacaggctcagggaaggcctccatattatacacctaaccagttagcacagatgaggcctaatccacgctggcagcaaggtgggagacctcaagaggtaggtggtggggaacagtaattgacagcccaggatatacctgtcctggtctcccctgcctttccttcttccccactctgaggcacagcctaggttctggtccacatcacttctcaatg

SEQ ID NO: 281459 - DNA, 3147 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281460 - DNA, 3515 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaaaaaaaaaaaaaaaaaaaaaaaaaaaaaaaaaaaaaaaaaaaaaaaaaaaaaaaaaaaaaaaaaaaaaggggggggggggtaaaaatttccgggggggggcccccagactgtagccaacagcaccagattgttggtcgaagagagggggcccccataagtggggacgaggcgactatataaacacagaaaggaagcagggggccggctgttttaaaaaccaacgcgtctcgtcgcgtggaacacaaccttgcatacgtggaggatattctgggggagaaggacccccttatgcgggcggtggcaccatatgtgggggacaccctaccagcaggatttagaagttcgaggggaaatcaacacgttgcagcgttatggggtgtacaccccgcgatatagctgcggtgaaaactgtgcca

SEQ ID NO: 281461 - DNA, 3602 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaaaaaaaaaaaaaaaaaaaaaaaaaaaaaaaaaaaaaaaaaaaaaaaaaaaaaaaaaaaaaaaaaaaaaaaaaaaaaaagggggggggggggaaaaaccggggggggaatgcccacgttttgtaagaaacagagggggcccccaagtagtggaggggagttattataaatcacagaggggagcgggcgcgaagttataaaaacaacaggtgtgagggagggaaaacaaacgccgttgtgcggaggatatcttttttgggagaaagaaagccaccactcatgtgtggggggagggaggaaacaataattggggaacaacaccctacacgcagaagatgattttacgcgcccccgggcgggcaaataataaaataaacgcgtggggggtttattatgtagtggtgcacccacacagcgtgtgattattgttgtgtgcggtagcataaaagattttgtgctgcacgacggcgatgtgatatatgaagaaaactaattttaccaggggg

SEQ ID NO: 281462 - DNA, 3647 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggtgagcaaactggcctttagaagtgtggcctggggaggagggagtcaggatgactaggctctgtcctgggttggtcagtttgttgggctcgaatttatcgagtcctggttctgtaatcttagctgtgtgcttaggtggccacttcaggagcagagaaacagtatgagttctaggtgtgtcagttgcttttaacattctttgctcatcggtgacctatgtgaaaaaggttagttgtagaagtttgctagctggatgaccacagaggcagcttgttcttttgggtggggtgaggaatacaaggaaacagtgtatacagaatatgtcttgtattccaagatgtggaaagagttgtatgttatcctttggctcatcctcgaaagtagtagtggccccctgtgcaatgtgttgcgtaaacgtgctttgaaatttctccttccgtgggacgtggccagttggacatctgccgccaacactgatgtgcatttgctggtctgttgtagggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281463 - DNA, 3241 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggtggtattggatgcacacagaagggggaaagatgggatttgacgggtctttgcccagactgatgggctttaattgtatttgttctttccctaaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281464 - DNA, 3193 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggtggtattggatgcacacagaagggggaaagatgggatttgacgggtctttgcccagactgatgggctttaattgtatttgttctttccctaaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281465 - DNA, 3284 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtgtgagtgtcccagtccggagcaacaaccatcgcatgagccagccgtggccccacctcgctattaactggcacacacaaggcggctactggttctcggcccaagtgtggcctgctcctacctctccactccagggctgatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 281466 - DNA, 3143 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgttcaagtgtcgaatcctcggagcacccg

SEQ ID NO: 281467 - DNA, 3310 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggtccgtggggcagacaggtaacttaataattggggaagataaccccagaatggctaattgatgtcccaggtcttagtcccattacgaaacatttcctaatcaaagaaaaaaggggaccgcaaaataccacgagccaactacgcgcccacatttgagcagggactagagaggataaaagcagcagccgcataacacgaggaaatacgtgactggacgcaattctgagtagtcaacacacacaccagatattagtacgcatcgcaattaacaaccaacacactagtacttgtaca

SEQ ID NO: 281468 - DNA, 2944 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtggtctcacggggggatacctctag

SEQ ID NO: 281469 - DNA, 3461 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgtatgtgtggctattttcatttttgttcctatgagcattgttcctatgagcattgtctttgtggtttgacctgaggttgtatatatgctcactgcttagctctgggaatacaataagtacagttagttacacggagtgtgttgcaggtgacttcttatcatgaggactgtggactttgtctgcaggagcttgagtgaataataaaactagtactggttgatggttgtaggtgtctccagatagggaaagaagagacagtaaaataagctaaggaaaaagcacatggtaaggaccagagctggtgtgttgggagggttgacttggcatagtcatgaccctcttgtcaagggcctcaggagccttgtcatctagtggtaaagaccagagatgctgctaaatgttgtacagtacacaggaggacagacccaacagaatgtccaaagtgtcaatagcactgaggttgagaaactctcttctagaataccttcctttatccactatatgttaatgaatctaaattatttgattatgcatttatttgtgttggtgcttttctttacagggattcaaaagccaaataaccccttatggaattcaactcaaggtttgaagacttcctagcttgtcctatgggctctacacagctgaagaataagtccggtgagtcac

SEQ ID NO: 281470 - DNA, 2784 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagcaccacgaatcgcacagcacgggatcctctagatcacc

SEQ ID NO: 281471 - DNA, 2293 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaagtccaacgaatgccaaggatatacgccagtcggggcccgtcaatccttgcaactggtccaacaggtaaggtcggctctctggctcctattacactcgccggccgatgcggccgtggc

SEQ ID NO: 281472 - DNA, 1716 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaattgaagtttctcatccttggcatttctcatcttgg

SEQ ID NO: 281473 - DNA, 1541 bp, Homo sapiens
  misc_feature (13)..(13): n is a, c, g, or t
agcggctctctcngccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtgtgagtgtcccagtccggagcaacaaccatcgcatgagccagccgtggccccacctcgctattaactggcacacacaaggcggctactggttctcggcccaagtgtggcctgctcctacctctccactccagggctgatttgtgggcagattcaagtctcgcaaagagcggattcgccatcggtaccgagctga

SEQ ID NO: 281474 - DNA, 1567 bp, Homo sapiens
ctttccggcaggctactgggctccgcccacacacctcccggcctggttcctaaacgccagctcggagcaatccccttgggctggagccaaatccctgctgtgattttaaggaagaccggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagacta

SEQ ID NO: 281475 - DNA, 9868 bp, Homo sapiens
  misc_feature (4570)..(4574): n is a, c, g, or t
  misc_feature (9456)..(9456): n is a, c, g, or t
cacccacttgctgcccaccatccccagctccctgagccagtctttcctgagacctggggtcccaggagtcctgaccctctggggggcttctctgcccacatccaaagggatgcctttgagaaggagctacactgccctttccttgtctcatgcctggctactcaggtgtcccactccactgctggttagaaaaattttggccattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281476 - DNA, 11432 bp, Homo sapiens
  misc_feature (6134)..(6138): n is a, c, g, or t
  misc_feature (11020)..(11020): n is a, c, g, or t
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281477 - DNA, 11276 bp, Homo sapiens
  misc_feature (5978)..(5982): n is a, c, g, or t
  misc_feature (10864)..(10864): n is a, c, g, or t
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281478 - DNA, 11583 bp, Homo sapiens
  misc_feature (6285)..(6289): n is a, c, g, or t
  misc_feature (11171)..(11171): n is a, c, g, or t
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggtaagatcctagccccctttagccctgtagcatgctggtctttccactggggccatcctcagccctggctgtcaggagagtgtgctgttcccacttcctgttcattccctgaggcccaggtggtaaccagcccctgtccctgtctcctcaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281479 - DNA, 11233 bp, Homo sapiens
  misc_feature (5935)..(5939): n is a, c, g, or t
  misc_feature (10821)..(10821): n is a, c, g, or t
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcacagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281480 - DNA, 2019 bp, Homo sapiens
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggtaagatcctagccccctttagccctgtagcatgctggtctttccactggggccatcctcagccctggctgtcaggagagtgtgctgttcccacttcctgttcattccctgaggcccaggtggtaaccagcccctgtccctgtctcctcaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagacta

SEQ ID NO: 281481 - DNA, 1538 bp, Homo sapiens
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctgggtatgaatgggatgggtctcctaggtctgtccccagcaggctcctctgctcctaatgtgtactgggcaggccctg

SEQ ID NO: 281482 - DNA, 242 bp, Homo sapiens
tttgagaagaggggtatccctgaggcccgggaatccagtgagtacatcgtggctcatgtccttggagccaaaacagttaagtttagtgttgtcaagaggacaggaagagggaggagggaggacttggggaagggatatccaggttttctgttcactaagagtgcttagctgagactgatgggatttttctgaaggaacgtcttagcgcctggcacacactgtaacagtttgttggatgaatg

SEQ ID NO: 281483 - DNA, 11131 bp, Homo sapiens
  misc_feature (5833)..(5837): n is a, c, g, or t
  misc_feature (10719)..(10719): n is a, c, g, or t
ctttccggcaggctactgggctccgcccacacacctcccggcctggttcctaaacgccagctcggagcaatccccttgggctggagccaaatccctgctgtgattttaaggaagaccggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281484 - DNA, 11403 bp, Homo sapiens
  misc_feature (6105)..(6109): n is a, c, g, or t
  misc_feature (10991)..(10991): n is a, c, g, or t
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctgggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281485 - DNA, 11496 bp, Homo sapiens
  misc_feature (6198)..(6202): n is a, c, g, or t
  misc_feature (11084)..(11084): n is a, c, g, or t
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcaggtatgcatgggaggtggggatcggaacggggtgtttcgactgcaaccgcctggagacctggccgggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281486 - DNA, 10444 bp, Homo sapiens
  misc_feature (5146)..(5150): n is a, c, g, or t
  misc_feature (10032)..(10032): n is a, c, g, or t
aatcttgactccttttcaggtttcaaactcaccaatgtctgatttctactcccaagaaggaggaagcagtggggtagcctggcatgggtcccatggggttctgaatgggtagtgggcagtgagtatcttgccagtccaagaagggttgactataagacctcattcttgtagtgaagggtaggggtctgcccccgtgcctacccctttctccctgtctgtgtaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggcccgtcagtcccctgcttggtagtggtgtgggggtgcagtgtggaggaaggcacgtgagtcctcactcctggccttggataccatgggtcctggcataagcagctcactcccagtgattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactaactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcaccaggatgtgaccttgggcagatgacttcacctcactcagccttggcttctaaggctgagaaatgggacttaatgcttttttattttataggatgcatgtgaggagcccatggaatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcgctgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccaccnnnnntctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagttaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggccaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtgctacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggtgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggtttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaacngagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatg

SEQ ID NO: 281487 - DNA, 1674 bp, Homo sapiens
ctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagagctctgtccctgatgaccacccagctgccccctctgcaggatgccggtgcagtacatccttggagagtgggacttccaggggctcagcctaaggatggtgcccccagtgtttattccgcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtttctcttagaagtgacccagcaccggactgtcagaagtggttcagaaccggctgactgtactaatctgggtgtggccggacttcgtggagccggcctggaaccggggtggcaagatgggccgtgtgcttgagcgcactacaagggggggggtcaaccgctttgttccct

SEQ ID NO: 281488 - DNA, 2228 bp, Homo sapiens
aacacttttttctcctttgatcatttttattcattattgaattggtgaacccatccagcatggttggaactccctaaaaaaaaaactagtaggattgaaggaaaaaaattacagttatcattcccagctagtatgtttagataatcaaagactagaagaagctatatattattagaaaaagaaagtttatagcaaagttgtagaatattcaatatataaaagttaattatatttttacatcccttttatgattgaattaataaatattaaagttaattgggaaaacatctagcaaaatatttgtaaaactttttgtagaactggaaaattttatttaaagataacctaaataaatgtagagatatgccatttatggatgctttggctgtgatattctaatacggtttttccttgcagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtcc

SEQ ID NO: 281489 - DNA, 1497 bp, Homo sapiens
gttatctggccagggaatagagaggtcaaaaggtgggagggtttagaaatgaattccgaaactcaggaaccaggaatgcataaatgaagagtatactgaagggctgaccaaaaatgtttcactgcctttcctaataaaaagtggttactgatcattttcattgacatttagggtgatgtatgttggtcttttctgataaagagttttgcatttaagacctattttttgtggtcttaaaaataagcttgtatgcttgcacacataaatacacattacacatctaccaagagattgttctgatttacaaaagatagaaaaatgttttattttttggttttcttaacattttttagtcagactttataacaatgtatttacaaaaattatgtaacgtgtactgccatatttacataactgatgaaaggagggtatcattacaagtaactagacagtactgtaaatctactgtaatcctgttttgcagaatactgcacgacggagattgagaagtgagagctcttatgacatagataacattgtgattcccatgtcattagtagccccagctaaattagagaaactccaatataaggaaatacttactccaaggtatgtatacttacatcttcatatttttcttccttccttccctaataaacttaaattttcaaagtgaagaattttaattaatgaaaggagcatccttctcccagttccttcatagccatggaggggaaacggtgaaaaaaaaattactcgtgccttaagtgttatatagtatcacaactttatttctcagtttttattaagatttaggaattcctagactactttagcattcttagtcttttttattattattatccagtgttatctactatgtatatgacactaaaaggtactttagtgacataaaaactatagcaacaaataatccttgcccttgaagatacaggtgtgacataagttgcaaagagttctacgttttcatggggtattcacactgtaagacagtaatacctgtgaccaaaaaaaaaaaaaaaaaaaaaagattttgatgcattgccaagtcagcaataaacacattcaaaagatgagtgggaaggtctgggaagtcatccatgaaggaatgggaaggtggagaaggtatttacatagggatacgacaacaaaggcacaggacaagtgtgtaaggcttagccagatactgttttgtgcaggttgataatggaaggctaaaaacaaagttaggtccagattgataatggaaggctagagacaaagttaggtccagatttgtggaggtccctgaatgccatacacagatctgctccctactggcagtaacgttagccaaactttttagaaatcatgaatgcagcttcttaagaatataaatgacaccaggaagtagagacagaaaaggctgcaaacagagacaggtgggtgacaatttcagtcaattgctatacatctctattctaatttcatttcttt

SEQ ID NO: 281490 - DNA, 881 bp, Homo sapiens
ttttgtcactcaacaattctcaatatattccattttgagttgctatttaagttgaaatgaaaaattgtacatttatgtgctaaagaacagaacaattattacaatatagacatgtacagattacttgttagatgaatttaaacaaaacaagttagttgaaacttaactgaaaatttttcccctttcagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcacccggccaggcgcagtgagttttaaaattcgatgcttctgactctaggacaacccttgacttgattcagaaccccacgtagatgactctccaggcacgccactctgaaagtcgaatccagcacgactcgggtatctccgggcgatttattgtatctcgagcgcgaaatccatagcaacatagtacatgtacacggctactaccataggaaacagctatgcacatgtccactaatcttctagagacagcgcgccatccgtatggtcctaggtagct

SEQ ID NO: 281491 - DNA, 1946 bp, Homo sapiens
aacacttttttctcctttgatcatttttattcattattgaattggtgaacccatccagcatggttggaactccctaaaaaaaaaactagtaggattgaaggaaaaaaattacagttatcattcccagctagtatgtttagataatcaaagactagaagaagctatatattattagaaaaagaaagtttatagcaaagttgtagaatattcaatatataaaagttaattatatttttacatcccttttatgattgaattaataaatattaaagttaattgggaaaacatctagcaaaatatttgtaaaactttttgtagaactggaaaattttatttaaagataacctaaataaatgtagagatatgccatttatggatgctttggctgtgatattctaatacggtttttccttgcagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaaggtatgtatacttacatcttcatatttttcttccttccttccctaataaacttaaattttcaaagtgaagaattttaattaatgaaaggagcatccttctcccagttccttcatagccatggaggggaaacggtgaaaaaaaaattactcgtgccttaagtgttatatagtatcacaactttatttctcagtttttattaagatttaggaattcctagactactttagcattcttagtcttttttattattattatccagtgttatctactatgtatatgacactaaaaggtactttagtgacataaaaactatagcaacaaataatccttgcccttgaagatacaggtgtgacataagttgcaaagagttctacgttttcatggggtattcacactgtaagacagtaatacctgtgaccaaaaaaaaaaaaaaaaaaaaaagattttgatgcattgccaagtcagcaataaacacattcaaaagatgagtgggaaggtctgggaagtcatccatgaaggaatgggaaggtggagaaggtatttacatagggatacgacaacaaaggcacaggacaagtgtgtaaggcttagccagatactgttttgtgcaggttgataatggaaggctaaaaacaaagttaggtccagattgataatggaaggctagagacaaagttaggtccagatttgtggaggtccctgaatgccatacacagatctgctccctactggcagtaacgttagccaaactttttagaaatcatgaatgcagcttcttaagaatataaatgacaccaggaagtagagacagaaaaggctgcaaacagagacaggtgggtgacaatttcagtcaattgctatacatctctattctaatttcatttcttt

SEQ ID NO: 281492 - DNA, 1580 bp, Homo sapiens
ttttgtcactcaacaattctcaatatattccattttgagttgctatttaagttgaaatgaaaaattgtacatttatgtgctaaagaacagaacaattattacaatatagacatgtacagattacttgttagatgaatttaaacaaaacaagttagttgaaacttaactgaaaatttttcccctttcagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtccctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagtataaaatttgaaaaaaaaaaaaaagatgattgtatttctagattagcaagaaattagttaattctggctgatttctatttctagctaatttggtcattctttgccatagcttactctattcaaataaacatatattcttgcttgcatcctagattggaaattaaaatttttcaaagaacaaagcttcaatattggatactgaagagtatacatgaaagaaaattccttttgaagctatt

SEQ ID NO: 281493 - DNA, 1961 bp, Homo sapiens
tatatgagaaaattcctattttatatttattatacatttgatcatttttaaaatagccaaaactcaaaaaggcaagattgtgtgaagtctggtagtcactttagttaaggagcatctttcatttaattagtcagacaaaagacaaaagcaaacccaaataaaaaacaagaataaccctccccccacaactgttataattcggtaaaatatttcataaagtactatttcatcctctgagtatgaaaataataaatagcaccaggggaatttttaaaaatctttgggcaaaactgtttaaagttaccaagttaacttgactcagtgataccttgggttgttcataaattttcaagacctcaaaaaataaaaaataattgtgttttcctgattttcttgctagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtccctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagtataaaatttgaaaaaaaaaaaaaagatgattgtatttctagattagcaagaaattagttaattctggctgatttctatttctagctaatttggtcattctttgccatagcttactctattcaaataaacatatattcttgcttgcatcctagattggaaattaaaatttttcaaagaacaaagcttcaatattggatactgaagagtatacatgaaagaaaattccttttgaagctatt

SEQ ID NO: 281494 - DNA, 668 bp, Homo sapiens
catggaagtgccaaggaaacactaatacatttagctgtgctgagtataaaattgccacatttaaataaataaaagctgtttaaaattggtttttatcttcaacagctggaggatggttgttcttcagcctttggatgaatataatttaggcaaagaagaggtaagctgcctttcatttaatgggataattgcacattatgtattatgaaacctgcttactttgacattcagggaactaaaggaatatataagccctttaacttacactgatttttttcttttcacttatgaaaaggaagttcttttaaaagaatattcgaaaaatgttttgtgcaaatttgactaccagcataatatagaaatacacaataatttaaaaagccaaggccgggcgcggtggctaatgcctgtaatcccagcactttgggaggccaagacgggcggatcacgaggtcaggagatggagaccatcctagctaacacggtgaaaccccgtctctactaaaaatacaaaaaaattagtcgggcgtggtggtgggcacctgtagtcccagctacttgggaggctgaggcaggagaatagcgtgaacccgggaggcggagcttgcaatgagccgagatcgcaccactgcactccagcctgggcaacagagcaagactccgtttca

SEQ ID NO: 281495 - DNA, 2105 bp, Homo sapiens
ttgttttctaatacacgaatttaaacacacacacacaaaacaaggaatcaatcacctgtcatctaattaggaaagtaattctaatgatattagacttgtttaatgtgtaacattcaatggttctttccatggcaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtccctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagtataaaatttgaaaaaaaaaaaaaagatgattgtatttctagattagcaagaaattagttaattctggctgatttctatttctagctaatttggtcattctttgccatagcttactctattcaaataaacatatattcttgcttgcatcctagattggaaattaaaatttttcaaagaacaaagcttcaatattggatactgaagagtatacatgaaagaaaattccttttgaagctatt

SEQ ID NO: 281496 - DNA, 706 bp, Homo sapiens
taatttctgtatttttagtagagacagggtttcaccatgttgcccaggctggtcttgaattcctggcctcaagtgatcctcccacctcagccttcctaaatgctggggtgggaagatcgcctaagcccaggaggtcaaggctgcagtgggccgtgatcacgccactgcattccagcctgggcagagaccccgtctcaaaaaaaacaaaaacaaaaaccaaacaaggcctaatcaaatcagggctacatggaataaatgacttaactatataaggtacaaaattatgctctctacaccatgctatggacacctccctcaaggagtggatgctcacaggccctggggagttaatagagaatgtggcacttaaaatgaatagggcaagggatcagaccatgcactatcactgtatcctgtaaaatggcaggtttacttttttttattttattttttaaagtgacagggtctccctctgtcagccaggctggagtgaggtggtaaaattatagctcactgtaaccttaaactcctgggttcaagtgatcctcctgcctaagccttctggctgagggaggctacaagtatttgctaccacacccagataatttttttttttttttttttacttctgtagagacaggatcttgttatgttgcccatgctggtcttgaactggcctcaagcaatactcctgcctcagcctctc

SEQ ID NO: 281497 - DNA, 591 bp, Homo sapiens
ggggtggtggcacacgcctatgatcccagctattcagaaggctgaggtgggaagatcgcctaagcccaggaggtcaaggctgcagtgggccgtgatcacgccactgcattccagcctgggcagagaccccgtctcaaaaaaaacaaaaacaaaaaccaaacaaggcctaatcaaatcagggctacatggaataaatgacttaactatataaggtacaaaattatgctctctacaccatgctatggacacctccctcaaggagtggatgctcacaggccctggggagttaatagagaatgtggcacttaaaatgaatagggcaagggattttattttttaaagtgacagggtctccctctgtcagccaggctggagtgaggtggtaaaattatagctcactgtaaccttaaactcctgggttcaagtgatcctcctgcctaagccttctggctgagggaggctacaagtatttgctaccacacccagataatttttttttttttttttttacttctgtagagacaggatcttgttatgttgcccatgctggtcttgaactggcctcaagcaatactcctgcctcagcctctc

SEQ ID NO: 281498 - DNA, 10879 bp, Homo sapiens
  misc_feature (951)..(951): n is a, c, g, or t
  misc_feature (4623)..(4623): n is a, c, g, or t
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacnaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcactngccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagaacccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281499 - DNA, 1084 bp, Homo sapiens
atcccccgggctgcaggattcggcacgaggttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281500 - DNA, 512 bp, Homo sapiens
agtcattacagcacaatttcattttactattattagaactttaatgaattttttcctaatggaattataccaaaaatgttctcagaacattgctgaatttacctatgtctttccctctctttctgacagtggcttgcaaattgtaaggcaacatttgcagggggatcaagagatggagtaattacctgtcaaccaggggactccgaagaaaaggtaataaaagcctgttagaatgggtctcttgtgtgctctaacattgtgtattagttttggtctacccaagaagcctggaacttgagaaaagaagaggcggaatgagtcaccccaaacatttacatgaaaccaacagagtaagacagaatgccttccagcatgactgtgtgttgatgggatttgtggggaggtttcttcgttttggaaaagtagaggtataaaataaccttttttgctggatactgtctaactatactaataatttcctaataaatttattcttaattcagaaaataagg

SEQ ID NO: 281501 - DNA, 866 bp, Homo sapiens
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatagtgagtaatagaaaataacctttttgtttgtttgtttgctggatgttgcataaggctggagacagagaatctcaactggacacacatgtttgtgagccgcggaagtttttctttttttcttttcttttct

SEQ ID NO: 281502 - DNA, 8537 bp, Homo sapiens
  misc_feature (2281)..(2281): n is a, c, g, or t
cgatgagtaatcttggcaggcgtgagccaccatgcctggccaaattagaagtttttttaaaggtatttatgaagtcatttactaagcaaaaaataagggagacccattttcagactcaagtagaagagatatacattaatatctgttaatccttgttagctctagaagaccagttaataaagtaaatgattttattttcctttattcgtttcacaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcactngccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagaacccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281503 - DNA, 5511 bp, Homo sapiens
ctcatagctgactcctgagggaaaacctgcgtcagggagagaggaacctacgatgaagagtaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281504 - DNA, 10806 bp, Homo sapiens
  misc_feature (951)..(951): n is a, c, g, or t
  misc_feature (4623)..(4623): n is a, c, g, or t
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacnaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcactngccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagaacccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281505 - DNA, 10824 bp, Homo sapiens
  misc_feature (951)..(951): n is a, c, g, or t
  misc_feature (4623)..(4623): n is a, c, g, or t
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacnaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcactngccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagaacccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281506 - DNA, 1782 bp, Homo sapiens
cctgtgccatgcttgctgtgtagcaaatggaatctcttgcacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281507 - DNA, 9399 bp, Homo sapiens
  misc_feature (951)..(951): n is a, c, g, or t
  misc_feature (4623)..(4623): n is a, c, g, or t
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacnaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcactngccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagaacccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtaataaaagcctgttagaatgggtctcttgtgtgctctaacattgtgtattagttttggtctacccaagaagcctggaacttgagaaaagaagaggcggaatgagtcaccccaaacatttacatgaaaccaacagagtaagacagaatgccttccagcatgactgtgtgttgatgggatttgtggggaggtttcttcgttttggaaaagtagaggtataaaataaccttttttgctggatactgtctaactatactaataatttcctaataaatttattcttaattcagaaaataagg

SEQ ID NO: 281508 - DNA, 203 bp, Homo sapiens
cagatgggcatggtcttcctccaggttctctgcaagccacaaaactgagcagtgcccctcctcttttagccaccacctgttcgcttggtgcatattgatgaaaatagccattttctgttgagtttatattttaacactttcattttgtgttcttgtttttactacaggaacgtttagattttgcaatgaaagaaatcattttc

SEQ ID NO: 281509 - DNA, 927 bp, Homo sapiens
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatatgcggtgccttctggaaaccatccaccatttgcacactaccccagtgcagaagatttagcaagtaaccagttcctggaaacgcgaatggcatttgtggaacaagataagacacaacttaacctcattttctttcatactaatgtctttcatttgatagatgccattcatcatattccttttaacattgctc

SEQ ID NO: 281510 - DNA, 3311 bp, Homo sapiens
actctaatcagttcagaaacagtggaacattttcctggctgctccagtttacacacacacacacatacacacacacacacaggtagtatacagtcttcatccattaaaaagcagcgacgtgattcttgaacattttcctggtgcatgaacttgcgtctttgccacgagtttaatctgaaggcacctgtccaacataaataataaaagaacattctaaaaatacccactgaaggaattaggtgtgtactggaaatacggtgctatgaagagccaattacaatttttcgtagcacaaacaaccaaagggagaacggtttctcaggagaggactcttgattcgcaggtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281511 - DNA, 3136 bp, Homo sapiens
actctaatcagttcagaaacagtggaacattttcctggctgctccagtttacacacacacacacatacacacacacacacaggtagtatacagtcttcatccattaaaaagcagcgacgtgattcttgaacattttcctggtgcatgaacttgcgtctttgccacgagtttaatctgaaggcacctgtccaacataaataataaaagaacattctaaaaatacccactgaaggaattaggtgtgtactggaaatacggtgctatgaagagccaattacaatttttcgtagcacaaacaaccaaagggagaacggtttctcaggagaggactcttgattcgcaggtgattttttcatcgtgtggggatctggatctgcttgagcaccagacaacctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaa

SEQ ID NO: 281512 - DNA, 9434 bp, Homo sapiens
  misc_feature (951)..(951): n is a, c, g, or t
  misc_feature (4623)..(4623): n is a, c, g, or t
agttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacnaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcactngccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagaacccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaaggtaataaaagcctgttagaatgggtctcttgtgtgctctaacattgtgtattagttttggtctacccaagaagcctggaacttgagaaaagaagaggcggaatgagtcaccccaaacatttacatgaaaccaacagagtaagacagaatgccttccagcatgactgtgtgttgatgggatttgtggggaggtttcttcgttttggaaaagtagaggtataaaataaccttttttgctggatactgtctaactatactaataatttcctaataaatttattcttaattcagaaaataagg

SEQ ID NO: 281513 - DNA, 513 bp, Homo sapiens
cagctgactctccagcagggcccggagaggattgggacagacctagcatcacggcggaactcccaagcctcaggttcagagtcacagaggagtatacagctgggagccagtgaacctgagggaggccatggaaaagacaaggacttccctctcctgctgacccaaaggcccatcttccgaattctggaacccccttttcatcaggcgctgcccatgtcgatcatcttgatgacatcatcagcagagttaaccagatgctcctgcagccccaccacttgcacctgttgcttgccgtcctccagcacgcgcagcttggccttcttgttgagcaggtcaaacagctgtgccaggcagggggaatgaggctaaggccactgggcacccggcaccccacccgactgcttcctcctactagcctgcccagctcggacaagagccagcagcaggaaaggcagagaatacgaactgatggatgtcagcctagcagaggtcaatatacttgggatctgagcc

SEQ ID NO: 281514 - DNA, 496 bp, Homo sapiens
gcaaaaggtcaagacatacaaactcagagtttttaaaatcaagaattgaaagtggtccactagcttctgttcataggacattgagccccagatttggcacatgaccgtcacccactcggaacatgaagcacagcttgccatttcggacggcaatcacagcatggcggctgaaaatcaaagtttctgcccttctgtgagcctgagctgttttcatgaaaatgcagcctaacatgactgcattgatgatcaaacccacaatattctggagaatcaaaaccgtgatggccaaagggcattcctctgtcatcatcctccctccaaacccaatggtaacttgaacttcaatggagaagagaaaagcagaagtgaaagacctgtgaggaatgatatcagaaaagaacaccatcaggtcacattttgaataatgaaatatgccaagctgagcttttcattttcttccaccaaagactattaaatgcttgcagaaagactagcc

SEQ ID NO: 281515 - DNA, 1339 bp, Homo sapiens
aatgcttccctgtctccttctgtactgtggaagctttgctcttttactctgcaataaatcttgctgctgctaactgtttgggtccacgctacctctataagctgtaacactcaccataaaggtcttacagcttcattcctgaagccagtgagaccacgaacccagcaggaggaacgaacaactccagacgcgctgccttaagagctgttaacactcaccgcaaggtctgcagcttcactcctgaagccagagagaccacgaacccagcaggaggaatgaacaactccagatgcgccgccttaagagctgtaacgctcaccgcgaaggtctgcagcctcactcctgagccagcgagaccacgaacccaccagaaggaagaaactccgaacacatccgaacctcggaaggaagaaactccaaacacatccaaacatcagaaggaacaaactctgcacacaccgcctttaagaactgtaacactcaccaccagggttcgcggcttcattcttgaagtcagtgagaccaagaagccaccaattccggacacaatatgaagggggaatctggaatatttcaagataaggtccaattcttccattgtctcgtaatccaatgcagagcatcatatcggatttgagaaaactcacgaagaccaaaagaacctccaacaatcagcaactaaaacaaagaaaggaaacatttaagcaaaacagaagaccagaattcaaattcagcctatctatagattgcttttctaaacaacaatagaggcacattatacaaaaattctatagattatttttcctggtgagtcaccattcatcttttagagtaaatgcagtatatactggctaggaaatcattatagcacatcattaccaaataccaaaatcgtcaccctatacctgtatttgaccttatgatttaaatgacatcataacaagcattgtattatctgactcttacaatagacctatttttgttttttgctaagaaaaaaacaaaaacaaaaacaaattcaacaaatgaggaaataaaagcacagccagctaaatgacttgtccattgttaacttaaattttgcccagggatgtctctgtaattccattgctatgcgatcttccttagtaagtaatgaaattgaaacctgatcaactgatcagaccatgtccaaataaggcagatgcctagctataaccaaccaagctatttctgtacttcactttcctgttttgtctatactcattgcccatattgcagaatggagctctctcaacttctggttctgagtgctgcctgattcatgaattttctttgttcaaataaactctataacatt

SEQ ID NO: 281516 - DNA, 773 bp, Homo sapiens
aatgcttccctgtctccttctgtactgtggaagctttgctcttttactctgcaataaatcttgctgctgctaactgtttgggtccacgctacctctataagctgtaacactcaccataaaggtcttacagcttcattcctgaagccagtgagaccacgaacccagcaggaggaacgaacaactccagacgcgctgccttaagagctgttaacactcaccgcaaggtctgcagcttcactcctgaagccagagagaccacgaacccagcaggaggaatgaacaactccagatgcgccgccttaagagctgtaacgctcaccgcgaaggtctgcagcctcactcctgagccagcgagaccacgaacccaccagaaggaagaaactccgaacacatccgaacctcggaaggaagaaactccaaacacatccaaacatcagaaggaacaaactctgcacacaccgcctttaagaactgtaacactcaccaccagggttcgcggcttcattcttgaagtcagtgagaccaagaagccaccaattccggacacaatatgaagggggaatctggaatatttcaagataaggtccaattcttccattgtctcgtaatccaatgcagagatgtgaaatgtaagatcatctgaaggagagctttggttcaagtcaaatgcatgcctcaacctagcagagccaaagagatacttgtatgatgtaagtcagattatgtcattcttctgctcaaaactctccaataaatagctcaccattcccttc

SEQ ID NO: 281517 - DNA, 977 bp, Homo sapiens
ctcggcgggccgggtctccagggaggacctgatttttcttcacccatagttagggaggcgcaatcgccctggctttggggctggggcctccggggaggttccggtaggggcgttggagaggccgctctttttgcaaggcccgagacggcgggccctgcgcaggccgccctattccgcgccctcagggcgtcagtatccgcctgaggccggataccccagctgggcccggatgccgtcgatgggcccggagcatcctcggcgctgccctcccagagccccgcagaggctgaggtggcgcggggggcgggcccggctccgcgagaagcagcggcagcgagggctggaggacccgggctacggggctctggggcgtctggcctgggtgggactgagcccattcggggggactccggggttctggtgtaggtagatccggggcaggctcaggaccaagtccctctccttccaccaaggagcgcccagaggccggcgggagctccaggttcacctcctcctcctccaggaaatcccacttccaactggatgtctggatgaactactgaaagctgctgagtgtcctgcagcagggtcggtggacctgggtgtctgtctggacacatcctccagtggcctggacctgcccatgaaggtggtggacatgttcaggagctgtttgcctgcgtgtgctgtgaacttcaagtgcttacatgagctggtgaaacatgaagaaaatggcctggtctttgaggactcagaggaactggcagctcagctgcagacggtaagggccatgtagaattgaggagcccgctggtgctcccggcaggcagccagcctccgcaggaccccgaccagcgacacgatggcttctgggcaatacagcacgtctacggtgaaagcttcaggttactgaaagggaccagcggacagttccaggtcatgctgacctcagcagaagggcgaggccagagaggcag

SEQ ID NO: 281518 - DNA, 901 bp, Homo sapiens
ctcggcgggccgggtctccagggaggacctgatttttcttcacccatagttagggaggcgcaatcgccctggctttggggctggggcctccggggaggttccggtaggggcgttggagaggccgctctttttgcaaggcccgagacggcgggccctgcgcaggccgccctattccgcgccctcagggcgtcagtatccgcctgaggccggataccccagctgggcccggatgccgtcgatgggcccggagcatcctcggcgctgccctcccagagccccgcagaggctgaggtggcgcggggggcgggcccggctccgcgagaagcagcggcagcgagggctggaggacccgggctacggggctctggggcgtctggcctgggtgggactgagcccattcggggggactccggggttctggtgtaggtagatccggggcaggctcaggaccaagtccctctccttccaccaaggagcgcccagaggccggcgggagctccaggttcacctcctcctcctccaggaaatcccacttccaactggatgtctggatgaactactgaaagctgctgagtgtcctgcagcagggtcggtggacctgggtgtctgtctggacacatcctccagtggcctggacctgcccatgaaggtggtggacatgttcaggagctgtttgcctgcgtgtgctgtgaacttcaagtgacggtaagggccatgtagaattgaggagcccgctggtgctcccggcaggcagccagcctccgcaggaccccgaccagcgacacgatggcttctgggcaatacagcacgtctacggtgaaagcttcaggttactgaaagggaccagcggacagttccaggtcatgctgacctcagcagaagggcgaggccagagaggcag

SEQ ID NO: 281519 - DNA, 352 bp, Homo sapiens
tcaaatcggtttggccattttgatgtgcacccccaggcctttatacccttcagatgccaaatctaagaaccagctcccagaaaccacacatcctgttccaacccccagcctggcttgagcgtgggtgggtgggagacaagctggacaccccaggggtctggtgtcttctccaggcagctctcaggctcccttggttctctctgcagcttacatgagctggtgaaacatgaagaaaatggcctggtctttgaggactcagaggaactggcagctcagctgcaggtagccatgtctgccaccacgccagggtgggcagggttctggagactggcaccgagccacaatccctgat

SEQ ID NO: 281520 - DNA, 761 bp, Homo sapiens
ggtacaacatttcctagggtaccgtcgtccacacagagttgtcgtgcattcatgttttggaccatgctaatgactgtagtgactggattatgttctaggtagattgtaagagtatgatcgaaggaattagaagaggagcggaacgcagaggggggaaacggggaagtagagacaggatgactagtggatgcttttggtgatgaataagagtgatgctatatcaaacacgagtacgctcttacgtgtaagcatcgaatttcattgattattatttcgaagctatttgcattttgtcattcaaacaggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccaggtaaactttcactgtagatagtaatgtaaaaatgttttattaacaaaaccaagttatgtggtcgtctctatcctgagctctctaacgtcatttgaaaaagctttttgccttttagggtgtgtataacactcttggaactctaatatgggaatatctaattatcctttttaggcaatatatctaaaaataaagacattgtggccaaaaatgttagctcattttttattttatacattttaaaattgtttatttttaagtgaaaattgtatttatggcatacaatataat

SEQ ID NO: 281521 - DNA, 1008 bp, Homo sapiens
gcggcccgggctggcagcctccgcttggcttctttcacacgggttgcttcggaggaatccgccgtgcaaatctgtccgcccccttggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttc

SEQ ID NO: 281522 - DNA, 1051 bp, Homo sapiens
aaaacttaggctaggtacgaggccgggtgttgatttcacacgggttgcttcggaggaatccgccgtgcaaatctgtccgcccccttggccactgatcccccgaagagcttctgtcgccgctctagggtaaaggagagctgcccctgcccctgcccccgcctatccgagaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttc

SEQ ID NO: 281523 - DNA, 1724 bp, Homo sapiens
  misc_feature (1322)..(1322): n is a, c, g, or t
  misc_feature (1325)..(1325): n is a, c, g, or t
  misc_feature (1330)..(1330): n is a, c, g, or t
  misc_feature (1351)..(1351): n is a, c, g, or t
gcggcccgggctggcagcctccgcttggcttctttcacacgggttgcttcggaggaatccgccgtgcaaatctgtccgcccccttggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgcttgttagaacgttttcattgataacaaagggtcaactagaagatgatttagtacatttatattaaatgttgtatctaaggtacgtcttctgaatttgtaggtcctataattagtatttttaaaaaaatcntgntaatnagcatctttcacagaattcgnttctttaaaatagtcaattttgtttttgcaattgtgtcaaatactaacaaattacacacctagtaattcagaaaaagatgtcttatttgtaaattcctaaacaaatttatgctaaaacatattagattcttaaggtttattaataacagcccgtttacgtttaacaaaacatttctggattaatgcgttaaattctggtatctggtggaccggagctggttttgaacgggagggctagcaggggtagggatacgctggtccaggttgaacaccggtgtgtgtggcccaatcctagacctgggcagcacgtatgtgtggggcccacccttttcaccccctgggagaggatgggaaatcggggacacggccccaa

SEQ ID NO: 281524 - DNA, 1016 bp, Homo sapiens
gcggcccgggctggcagcctccgcttggcttctttcacacgggttgcttcggaggaatccgccgtgcaaatctgtccgcccccttggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtggtgagttatataaaattaattattgaagtaaagcttagtcaaatttaaaataaatggttaagtaatgagccaaattgtataagaacttag

SEQ ID NO: 281525 - DNA, 1767 bp, Homo sapiens
  misc_feature (1365)..(1365): n is a, c, g, or t
  misc_feature (1368)..(1368): n is a, c, g, or t
  misc_feature (1373)..(1373): n is a, c, g, or t
  misc_feature (1394)..(1394): n is a, c, g, or t
aaaacttaggctaggtacgaggccgggtgttgatttcacacgggttgcttcggaggaatccgccgtgcaaatctgtccgcccccttggccactgatcccccgaagagcttctgtcgccgctctagggtaaaggagagctgcccctgcccctgcccccgcctatccgagaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgcttgttagaacgttttcattgataacaaagggtcaactagaagatgatttagtacatttatattaaatgttgtatctaaggtacgtcttctgaatttgtaggtcctataattagtatttttaaaaaaatcntgntaatnagcatctttcacagaattcgnttctttaaaatagtcaattttgtttttgcaattgtgtcaaatactaacaaattacacacctagtaattcagaaaaagatgtcttatttgtaaattcctaaacaaatttatgctaaaacatattagattcttaaggtttattaataacagcccgtttacgtttaacaaaacatttctggattaatgcgttaaattctggtatctggtggaccggagctggttttgaacgggagggctagcaggggtagggatacgctggtccaggttgaacaccggtgtgtgtggcccaatcctagacctgggcagcacgtatgtgtggggcccacccttttcaccccctgggagaggatgggaaatcggggacacggccccaa

SEQ ID NO: 281526 - DNA, 1331 bp, Homo sapiens
  misc_feature (929)..(929): n is a, c, g, or t
  misc_feature (932)..(932): n is a, c, g, or t
  misc_feature (937)..(937): n is a, c, g, or t
  misc_feature (958)..(958): n is a, c, g, or t
aaaacttaggctaggtacgaggccgggtgttgatttcacacgggttgcttcggaggaatccgccgtgcaaatctgtccgcccccttggccactgatcccccgaagagcttctgtcgccgctctaggaatacagacattgaagtttgggacaagatatttatctaacttctggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgcttgttagaacgttttcattgataacaaagggtcaactagaagatgatttagtacatttatattaaatgttgtatctaaggtacgtcttctgaatttgtaggtcctataattagtatttttaaaaaaatcntgntaatnagcatctttcacagaattcgnttctttaaaatagtcaattttgtttttgcaattgtgtcaaatactaacaaattacacacctagtaattcagaaaaagatgtcttatttgtaaattcctaaacaaatttatgctaaaacatattagattcttaaggtttattaataacagcccgtttacgtttaacaaaacatttctggattaatgcgttaaattctggtatctggtggaccggagctggttttgaacgggagggctagcaggggtagggatacgctggtccaggttgaacaccggtgtgtgtggcccaatcctagacctgggcagcacgtatgtgtggggcccacccttttcaccccctgggagaggatgggaaatcggggacacggccccaa

SEQ ID NO: 281527 - DNA, 1009 bp, Homo sapiens
aaaacttaggctaggtacgaggccgggtgttgatttcacacgggttgcttcggaggaatccgccgtgcaaatctgtccgcccccttggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttc

SEQ ID NO: 281528 - DNA, 942 bp, Homo sapiens
atacgaccctggaggcggatacattccaggtcttgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttc

SEQ ID NO: 281529 - DNA, 1662 bp, Homo sapiens
  misc_feature (1260)..(1260): n is a, c, g, or t
  misc_feature (1263)..(1263): n is a, c, g, or t
  misc_feature (1268)..(1268): n is a, c, g, or t
  misc_feature (1289)..(1289): n is a, c, g, or t
gcggcccgggctggcagcctccgcttggcttctttcacacgggttgcttcggaggaatccgccgtgcaaatctgtccgcccccttggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgcttgttagaacgttttcattgataacaaagggtcaactagaagatgatttagtacatttatattaaatgttgtatctaaggtacgtcttctgaatttgtaggtcctataattagtatttttaaaaaaatcntgntaatnagcatctttcacagaattcgnttctttaaaatagtcaattttgtttttgcaattgtgtcaaatactaacaaattacacacctagtaattcagaaaaagatgtcttatttgtaaattcctaaacaaatttatgctaaaacatattagattcttaaggtttattaataacagcccgtttacgtttaacaaaacatttctggattaatgcgttaaattctggtatctggtggaccggagctggttttgaacgggagggctagcaggggtagggatacgctggtccaggttgaacaccggtgtgtgtggcccaatcctagacctgggcagcacgtatgtgtggggcccacccttttcaccccctgggagaggatgggaaatcggggacacggccccaa

SEQ ID NO: 281530 - DNA, 1751 bp, Homo sapiens
  misc_feature (1349)..(1349): n is a, c, g, or t
  misc_feature (1352)..(1352): n is a, c, g, or t
  misc_feature (1357)..(1357): n is a, c, g, or t
  misc_feature (1378)..(1378): n is a, c, g, or t
atccccagtctcttcgcgggcaggctcggcttcccgccggcctcagtgttgcgccccagcgccagagtggccgggtgtggagatcctccctcctctgggtcaaagagcctgctctccccgcccctcttctcccctggcgctctaaaccttcgaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgcttgttagaacgttttcattgataacaaagggtcaactagaagatgatttagtacatttatattaaatgttgtatctaaggtacgtcttctgaatttgtaggtcctataattagtatttttaaaaaaatcntgntaatnagcatctttcacagaattcgnttctttaaaatagtcaattttgtttttgcaattgtgtcaaatactaacaaattacacacctagtaattcagaaaaagatgtcttatttgtaaattcctaaacaaatttatgctaaaacatattagattcttaaggtttattaataacagcccgtttacgtttaacaaaacatttctggattaatgcgttaaattctggtatctggtggaccggagctggttttgaacgggagggctagcaggggtagggatacgctggtccaggttgaacaccggtgtgtgtggcccaatcctagacctgggcagcacgtatgtgtggggcccacccttttcaccccctgggagaggatgggaaatcggggacacggccccaa

SEQ ID NO: 281531 - DNA, 495 bp, Homo sapiens
gaggcagatggtaggaaatggagacggagaaatggcactaatggcccagccacctgagatgggatacctgggagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattatgtctgctaacagacgctggtgggtaccacctgacgatgaagactgtgtgtctgagaagctcctgaggaagactcgggaatctccactggtgcctataggtgctgtgtacacaatgtacagcgattacgtcaagaggatggcacaggatgctggagagaagtaggactcctataggagccggggctgtccaactcccctaactcaatccctggtacattcctaataaagcagttttgaggaaaatcaac

SEQ ID NO: 281532 - DNA, 509 bp, Homo sapiens
  misc_feature (1)..(1): n is a, c, g, or t
  misc_feature (12)..(12): n is a, c, g, or t
nattcggcacgnggtggggaagaggcagatgactgaggaatcagagttctgattgtggagtgcctctctctaggacggggctgcagcataggagtctcagctgcttacatccaggtccaggattatgtctgctaacagacgctggtgggtaccacctgacgatgaagactgtgtgtctgagaagctcctgaggaagactcgggaatctccactggtgcctataggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgaggaaaatcaac

SEQ ID NO: 281533 - DNA, 630 bp, Homo sapiens
gaggcagatggtaggaaatggagacggagaaatggcactaatggcccagccacctgagatgggatacctgggagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattatgtctgctaacagacgctggtgggtaccacctgacgatgaagactgtgtgtctgagaagctcctgaggaagactcgggaatctccactggtgcctataggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgaggaaaatcaac

SEQ ID NO: 281534 - DNA, 657 bp, Homo sapiens
  misc_feature (1)..(1): n is a, c, g, or t
  misc_feature (12)..(12): n is a, c, g, or t
nattcggcacgnggtggggaagaggcagatgactgaggaatcagagttctgattgtggagtgcctctctctaggacggggctgcagcataggagtctcagctgcttacatccaggtccaggattatgtctgctaacagacgctggtgggtaccacctgacgatgaagactgtgtgtctgagaagctcctgaggaagactcgggaatctccactggtgcctataggtcccccgcaacgcccaccccccgccaccagatgctgcataaaaccagctgtttatccagatgcccagcctgcctggtaaggtatctctcatcaggggagtgctgtgcattgtggctgtggcccaggggctgtgttctctgcccacaggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgaggaaaatcaac

SEQ ID NO: 281535 - DNA, 660 bp, Homo sapiens
aaatcccggttagattgcaggcaccgccggacgctggctcccggaggttttagttttccctctaccaggagtgtgaagacacagagacttattgcgctggcgaagatggctgaggcgaaggcgtgtccgacttgtcctcggagttctgagggtttcagtgaccccagaaggctgagaagtggaatccgaactcgaggctgcccgaagcctcgggctgtttgagtgtagagccggtaggggagggctttcaaagtgtggccgcgagggcgagcgtgggggatcggttatgagctcccgagggcggggactctgctctgtgtcccctgaggaagtccagtcttgttataaggaagcctattccaggccgggggctgtggctcacgcctacaatacctgcattttgggaggctgaggccgggggatgatgaggtcaagagatcaagactatcgtggtcaacatggtgaaaccccgtctctactaaaaatacaaaaattagctgggcgtggtggcgcgcgcctgtagtcccagctatccaaatagcttaggcctgaaaaagggttttaacccaggagttgccaggtttaatggatccattattaccccactgtaaccttatctgggataatattgaaacttcctgttttattatttaaatatat

SEQ ID NO: 281536 - DNA, 814 bp, Homo sapiens
aaatcccggttagattgcaggcaccgccggacgctggctcccggaggttttagttttccctctaccaggagtgtgaagacacagagacttattgcgctggcgaagatggctgaggcgaaggcgtgtccgacttgtcctcggagttctgagggtttcagtgaccccagaaggctgagaagtggaatccgaactcgaggctgcccgaagcctcgggctgtttgagtgtagagccggtaggggagggctttcaaagtgtggccgcgagggcgagcgtgggggatcggttatgagctcccgagggcggggactctgctctgtgtcccctgaggaagtccagtcttgttataaggtatgagaaaagtaactttttaaaaatggacaaataataattgtatgttttatatactgatagggtacaatatgctgttttgatctatgtttacaatgcgaaatgattaaatcaagctaattaaatccatcacctcacttttttgtggtgaaaacatttaaaatctacttttagcaattttgaaacatgcaacacattatttatgtagttgctattctatgcaatcgattaacaaagtttatttctcctgactaactgaaattttgtactgttttaattaacatctcccttttccccatttttcagtctctggtaaacaccattctttgcctcttaagagttagacttttttagattccacaaataccacttatgtggtatttggtatttatctttctgttactggcttctctcacttagcataatgtcctcctggtttatccatgttgtcacagatgacagaat

SEQ ID NO: 281537 - DNA, 367 bp, Homo sapiens
gtttgctacagccttggtactgatcatcaaaagaacctggtgcgaagtcgaagtcgattttaattgcaacctgtaaaaaaagaaaaatcttgagtttaatttttcaaatcagatggtgaatgtggttgcagatttgctgtactctataagggtgctgccacacaatgggacagcatgggtggatccatggacagtctcagaagaagattgataagtgactagaacatggactcttgaataagacatctcagttcaattcctggtgctccttcttcctaaatgtgtgatcttggacaagctacttaacctctctgtctctctgtttcctcatgtgttgaatggagataataatagtaccaacttcatt

SEQ ID NO: 281538 - DNA, 1845 bp, Homo sapiens
gtgtttatgtataagattggtcaatgggttcagtccaatcggttcatgtgtagtctgttttttaaaaatctggaataagtttgtgtgtatcctgctaaatgtcatcttatttgctttagcccatcatcccattgtttggttcccatgtctgccaccaaatgtctccttcttagattcatatcatctgaaaatttgttaagcctgttaactttgtattcatccaaatccacataaacatgttgaacaggatagagctgaggacagagccctgtggcatgctactaaagactttcctccagactgacatggatcaagcatttttggggtatggtaactcaaccagttctgaatccacttagtatgataacacaatccacaatttctcatgttcttcatcgaaatatcattagagagagacagagatatctagttttcagttagaaagataagattatagtttaatagagagataagggctggagagaaatttggaagcaatctgtatcaggttttgtcacctggctaccacagaatcccctggggaacttcctggcttcacctggagattctgattctgtagtctggagtgggactaagaatctgtgttcttactaagttccccaggtgattcaaatgcagctggtctgatgactgatgttgggggaccacagatctgtatcactgggatagctggggcagagagaatggataagttctctgaggagagtgtttcatggggcgggaggagggctaaggataacactgaggagtgcgcatgggagaaaaggaaagagagccaaagacaaggaacccttggagaagcagtggcaggtggtgcctcaggcctggggcagaaagagggctggatgctgcgcagaggcctggccagcacctaggcagagcccacagcactggtgaccagcaagaaggcagcactgtggagttgtggaccctggagttgcatttctggtttttaaggaaatagtgggtaggagagaaagtgtcagaatcaaattataaaagtgtagcagcaaaagggagacaatggtgttcaagggaagactttctttaaggaggcaagggcaggagcttgaaaacagaggggagggagccaagtggtgaggtaaggagtgaagatacaggagagtggaggaataggaggcagcaggaactgctggaggcaggaaggagggaactgagcaatgtggaggccggggctgggcagcaatgagccttgtgaaggagatggaccccttctccccaggagagagggtacctcctggtgcataggtagatgaggagggcagatggaagacttgaagggggctcttagaactggttcagggaagcagaaaatatgagataaagggaccagacttgggatttgaggcaagataagatgatttggcaggcactgggaagcatttcaggggattaccactagatgatgaaaaggtgctaagcaaggagggtagaggcagaggcagtctaggtgagtgtgtagcgggcttggtgttgataagagttaaaaagagcatggccaggcgcagtggctcatgcctgtaatcccaggactttgggaggccaaggcaggcagatcacttgaggtcaggagttcgagactagcctggcaacatggtgaaaccctgtctctactaaaaatacaaaaattggccgggtgtgatggcaggcacctgtaatcccagctactcgggaggctgaggcaggagaattgcttgaaccccagaggcgggggttgcagtgagcagagatcgtgccattgcactccagcctgggtgacaagagcaaaactccgtctcaaaaaaaagaaaaaaaaaagcagat

SEQ ID NO: 281539 - DNA, 3430 bp, Homo sapiens
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtagggatagagctgaggacagagccctgtggcatgctactaaagactttcctccagactgacatggatcaagcatttttgggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281540 - DNA, 2719 bp, Homo sapiens
ctggcagaccgacggcgagtggaactcgagcacctccccaggtgcgcctaattcgaagggcagtcagaatggcggagccaagttcctggcacccctcttcagtttcccctcaacttgagaggggactcccccgcaggcggggcagagtggaccctgggaccccagcccaagacttttccggagaagaacactcgctccagcctcttcccgcggagcacctcccaccagttttcatggcgcccaccctgaacccccgatcgccccaacctttctccggcctccctcaccttgagcggcgctcccagcaggcggtgcaccgcgggtatctgcgcgcccaagggcagcgccccgtccaggctgcaggtgggggcccggcgcggctccggaaagttggcacatgcgaaggggtcggtgtcttccagtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtgtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281541 - DNA, 3868 bp, Homo sapiens
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaaggcatgtcttccctcagggactcctcttgggagctggaggctgacagcaagcagttttgagccccctagtgttaggatccagcttagggggaacccagttgggacagtcctcaggggcttgatgactacagcagtttgggttcccttttagatgttcctggagtcccagaagggtaaggtgagaccttcagagggggagcagcctcttggccatgtggtcacctgctgggaggcagcagggccgcctaccaaagatgaaaaaggcaggagaaaaggagattcctttgaggggcaactccatgagctcctaagtcagcccacgctgatgcatccagatttcttactggggcatgggtcactcttgcctggttggccaagggatggtagaaccactgggactgacataaattccctcccctgctgggttaggaaaacttgtcctgttgaccccaccagatgacagggttggggtgggaagccggggccagaggctcaggttttctttcttggtcctcagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281542 - DNA, 2824 bp, Homo sapiens
ctggcagaccgacggcgagtggaactcgagcacctccccaggtgcgcctaattcgaagggcagtcagaatggcggagccaagttcctggcacccctcttcagtttcccctcaacttgagaggggactcccccgcaggcggggcagagtggaccctgggaccccagcccaagacttttccggagaagaacactcgctccagcctcttcccgcggagcacctcccaccagttttcatggcgcccaccctgaacccccgatcgccccaacctttctccggcctccctcaccttgagcggcgctcccagcaggcggtgcaccgcgggtatctgcgcgcccaagggcagcgccccgtccaggctgcaggtgggggcccggcgcggctccggaaagttggcacatgcgaaggggtcggtgtcttccagtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtagggatagagctgaggacagagccctgtggcatgctactaaagactttcctccagactgacatggatcaagcatttttgggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281543 - DNA, 1926 bp, Homo sapiens
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtagggatagagctgaggacagagccctgtggcatgctactaaagactttcctccagactgacatggatcaagcatttttgggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattagaccatggaatgtgagatgagaacacaaaggagcatcaaatcacaaagagagaatgacacaccaaagggggatg

SEQ ID NO: 281544 - DNA, 3741 bp, Homo sapiens
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281545 - DNA, 2389 bp, Homo sapiens
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281546 - DNA, 2516 bp, Homo sapiens
tctctggctgggttcctgttgtattttttgttttgtttttcaatccattgttaattctggaaaagctgggctggcaggtcctgtggtgaatatgttggggctgtggcctggggttcttgtgggaggccaaggcatccatcctcatagccaggcggggctgtcattgccagtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaaggcatgtcttccctcagggactcctcttgggagctggaggctgacagcaagcagttttgagccccctagtgttaggatccagcttagggggaacccagttgggacagtcctcaggggcttgatgactacagcagtttgggttcccttttagatgttcctggagtcccagaagggtaaggtgagaccttcagagggggagcagcctcttggccatgtggtcacctgctgggaggcagcagggccgcctaccaaagatgaaaaaggcaggagaaaaggagattcctttgaggggcaactccatgagctcctaagtcagcccacgctgatgcatccagatttcttactggggcatgggtcactcttgcctggttggccaagggatggtagaaccactgggactgacataaattccctcccctgctgggttaggaaaacttgtcctgttgaccccaccagatgacagggttggggtgggaagccggggccagaggctcaggttttctttcttggtcctcagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgga

SEQ ID NO: 281547 - DNA, 518 bp, Homo sapiens
gcttttgtgtggcctttctcctgtgcaaatgcttctgtattgtattctgtccatttacatttctctctccattgggccacagcccccttgaggctgttccctgtctcctgtgcctaaactattaaattaatcctttgtgatttctccaaatgaaatgaggcagacctactcccattcacttcatatttcaaatactttataacttgttctgaacaagtgtttcacttgaactccattgcccacagcattttgctgctttgaaagcctgctaataggctctcagattttaactgtgaagatcttccaatgcttgagagttggtggcagtgtactagggagtgactattgctttccaaactgatgagagctcctgagtagaaattgagggtgttggtaatgaaagggggtgtcttacttgtaaaggcaaatgaaataatataacatgttttgagtaatctttactgccattgcagtcagtggttttgttttttttccttagcatcaagaaatcgccagga

SEQ ID NO: 281548 - DNA, 1118 bp, Homo sapiens
ctcctcctctggtcctatacatgggtgcacacagatgtttgggttgaagtaaacaactcattcttcccttctagattcccagaagtcactgttgggtatatgaccctctgtttagccaacttgaaattgaagtccttaacacccttggtgtgactgttctcagtgagaacgaggtaagtggtttaaaggggagcagacagaactgtaaaaatcctgaccagactcaccccaggccctgcctgtggacaccagcattctttgcagtggcagccattcctctcttaccgcctgctcacttttgtagtgcctgaacgatgtaaccagccaatcagttacctacattttggcttgtgttgtgcccatcagaaaaaaattacacagatagcatgaaccagaacatgttaggtctgcaccacttttttgagaattatttgtctggaaattatgctaacttggtatttgctgttgctactgaaacataaaagtctaggtgcctcaagtgaggtctttgtggttggattttatcctgtcccagggaggtaataaaaggggatgcagcattcctctttgatgctataacccagtcaaacccatagcacctggctgtgagttgtggattaattctctgcccatgtttgcaccccccaaaatagctgggatttgacatttctgagacctgtggaataaagaaatgcatccctaaagcacagggccaaagccagtatgagcaaatccctccgatttcggttttgtattgtcttggggattagaatcttttgattcctgtgtgtgtgctgaaactgccatcttattgcttattatgtatgaaaatttggctcagttgagagaagagtcattccctgatattggcaaggtcctaaaacactgtcactcagttcagatcatctttctgggtgcctgttctgtgctaggcagggagctttggggagaccaagaaaaatgggagccagtccctgtgttcagggagcccatggtcaacaagtgaatgaggaatgaaatactgaggcagaaccttgtactacgacaggtgttcggagggatggaggaaggattcctgggtctgagctgggctttgaaggtctaccaggagtttgcta

SEQ ID NO: 281549 - DNA, 1565 bp, Homo sapiens
agcgggtccgagaccaatggctgcggccgcagctgcggcgctggaatcctggcaggcggcggctccgcggaagaggcgctccgcggctcgacggccgcggcggagggaggcggcgccccgggggagagaggcggcgccccgggggagagaggcggcgccccggggccccgaggcggagttcgagtctgacagcggagtcgtgcttcgtcgcatctgggaggctgagaaggacctgtttatctctgatttctggagttcagcactagaaaccatcaatagatgtctcacaaaacatctggaacaactgaagacccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagcctaccatcttttacatgctccattgtgggacggccttgtacaacaatcttttatggagtaactggtcagtagatgccctttctaagatggtcatcattgggaacagtttcaaaggacttgaggagaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaaaaaaaaaaaaaaaaaagaacaaaggggggggagcataaagaataccccggggggcgcagtttacggctacgacggttttttgtcaaaggggcctaatagggagcgatataaaaacagagagggcgcgcgttaaaacgtgctgcggcaaccggtcgctgggcatttgggaggacccctctttgcggggtggcatgtggagaccccagagataaggctagggaaatacaatgggggtatggtaccccgttgtggtgaatggtcggcttta

SEQ ID NO: 281550 - DNA, 1572 bp, Homo sapiens
  misc_feature (738)..(738): n is a, c, g, or t
  misc_feature (756)..(756): n is a, c, g, or t
  misc_feature (773)..(774): n is a, c, g, or t
ggcccccatggcccgggggatagacccgaaccgacatcgatgtggggccggaatttgactcgaagccgacatcgaattttttttttttccttgcccggctgatttttgtatttttagtagagatggggttttaccatgttggccatgctggtcttgaactcctgacctcaaatgatccgcccgcctcagtctcctgaagtgctgggattacctgcgcctggcccacattttcaactatttaactggtttactccacatcttgagttttttcctgaattcttactatgcttcaatcatcttgcccttctatgtgtcttaaaagttgaatgaaactatcctcatacctcctaatcatggtgtttttttttgtttttttggttttttttaatttctaggttgttggcaaggattctgcagaaaaattatccctacattgcaaaggtatctatctgaataaaggggctgggatggaaaagggtgtgaaactgtgaagaattctatctttctttacaggcgtaggaggaaactcatgggctaagtggcgctagtgtactgtcagctctctccatgggtctgtgttccagaaagctatgactctttaatgcatctcttagttttttccttatttcctttattcttagtatcacagtccatgatatccactgtccttggggcgcccaattcattgtgcaaaagcatttaaatcaaaataccctatttgttatttttttaaaaagnaaagtggggatgacaagnaaagtggaaatttatcnnagaagagtggggattactgtgactatctgaagtttttatacttgaatttttctgctcagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaaaaaaaaaaaaaaaaaagaacaaaggggggggagcataaagaataccccggggggcgcagtttacggctacgacggttttttgtcaaaggggcctaatagggagcgatataaaaacagagagggcgcgcgttaaaacgtgctgcggcaaccggtcgctgggcatttgggaggacccctctttgcggggtggcatgtggagaccccagagataaggctagggaaatacaatgggggtatggtaccccgttgtggtgaatggtcggcttta

SEQ ID NO: 281551 - DNA, 1373 bp, Homo sapiens
agcgggtccgagaccaatggctgcggccgcagctgcggcgctggaatcctggcaggcggcggctccgcggaagaggcgctccgcggctcgacggccgcggcggagggaggcggcgccccgggggagagaggcggcgccccgggggagagaggcggcgccccggggccccgaggcggagttcgagtctgacagcggagtcgtgcttcgtcgcatctgggaggctgaaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagcctaccatcttttacatgctccattgtgggacggccttgtacaacaatcttttatggagtaactggtcagtagatgccctttctaagatggtcatcattgggaacagtttcaaaggacttgaggagaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaaaaaaaaaaaaaaaaaagaacaaaggggggggagcataaagaataccccggggggcgcagtttacggctacgacggttttttgtcaaaggggcctaatagggagcgatataaaaacagagagggcgcgcgttaaaacgtgctgcggcaaccggtcgctgggcatttgggaggacccctctttgcggggtggcatgtggagaccccagagataaggctagggaaatacaatgggggtatggtaccccgttgtggtgaatggtcggcttta

SEQ ID NO: 281552 - DNA, 1236 bp, Homo sapiens
tttttttttgagatggagtctcactctgtccccccggctggagtgcagtggtatggtctcagctcactgcaacctctgtctcctgggttcaagcgatactcctacctcagcctaatgagtagctgggattacagatgcacaccaggacgcccggctgatttttgtatttttagtagagatggggttttaccatgttggccatgctggtcttgaactcctgacctcaaatgatccgcccgcctcagtctcctgaagtgctgggattacctgcgcctggcccacattttcaactatttaactggtttactccacatcttgagttttttcctgaattcttactatgcttcaatcatcttgcccttctatgtgtcttaaaagttgaatgaaactatcctcatacctcctaatcatggtgtttttttttgtttttttggttttttttaatttctaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaaaaaaaaaaaaaaaaaagaacaaaggggggggagcataaagaataccccggggggcgcagtttacggctacgacggttttttgtcaaaggggcctaatagggagcgatataaaaacagagagggcgcgcgttaaaacgtgctgcggcaaccggtcgctgggcatttgggaggacccctctttgcggggtggcatgtggagaccccagagataaggctagggaaatacaatgggggtatggtaccccgttgtggtgaatggtcggcttta

SEQ ID NO: 281553 - DNA, 1544 bp, Homo sapiens
agcgggtccgagaccaatggctgcggccgcagctgcggcgctggaatcctggcaggcggcggctccgcggaagaggcgctccgcggctcgacggccgcggcggagggaggcggcgccccgggggagagaggcggcgccccggggccccgaggcggagttcgagtctgacagcggagtcgtgcttcgtcgcatctgggaggctgagaaggacctgtttatctctgatttctggagttcagcactagaaaccatcaatagatgtctcacaaaacatctggaacaactgaagacccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagcctaccatcttttacatgctccattgtgggacggccttgtacaacaatcttttatggagtaactggtcagtagatgccctttctaagatggtcatcattgggaacagtttcaaaggacttgaggagaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaaaaaaaaaaaaaaaaaagaacaaaggggggggagcataaagaataccccggggggcgcagtttacggctacgacggttttttgtcaaaggggcctaatagggagcgatataaaaacagagagggcgcgcgttaaaacgtgctgcggcaaccggtcgctgggcatttgggaggacccctctttgcggggtggcatgtggagaccccagagataaggctagggaaatacaatgggggtatggtaccccgttgtggtgaatggtcggcttta

SEQ ID NO: 281554 - DNA, 1549 bp, Homo sapiens
agcgggtccgagaccaatggctgcggccgcagctgcggcgctggaatcctggcaggcggcggctccgcggaagaggcgctccgcggctcgacggccgcggcggagggaggcggcgccccgggggagagaggcggcgccccggggccccgaggcggagttcgagtctgacagcggagtcgtgcttcgtcgcatctgggaggctgagaaggacctgtttatctctgatttctggagttcagcactagaaaccatcaatagatgtctcacaaaacatctggaacaactgaagacccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggtaagtggtttaaaggggagcagacagaactgtaaaaatcctgaccagactcaccccaggccctgcctgtggacaccagcattctttgcagtggcagccattcctctcttaccgcctgctcacttttgtagtgcctgaacgatgtaaccagccaatcagttacctacattttggcttgtgttgtgcccatcagaaaaaaattacacagatagcatgaaccagaacatgttaggtctgcaccacttttttgagaattatttgtctggaaattatgctaacttggtatttgctgttgctactgaaacataaaagtctaggtgcctcaagtgaggtctttgtggttggattttatcctgtcccagggaggtaataaaaggggatgcagcattcctctttgatgctataacccagtcaaacccatagcacctggctgtgagttgtggattaattctctgcccatgtttgcaccccccaaaatagctgggatttgacatttctgagacctgtggaataaagaaatgcatccctaaagcacagggccaaagccagtatgagcaaatccctccgatttcggttttgtattgtcttggggattagaatcttttgattcctgtgtgtgtgctgaaactgccatcttattgcttattatgtatgaaaatttggctcagttgagagaagagtcattccctgatattggcaaggtcctaaaacactgtcactcagttcagatcatctttctgggtgcctgttctgtgctaggcagggagctttggggagaccaagaaaaatgggagccagtccctgtgttcagggagcccatggtcaacaagtgaatgaggaatgaaatactgaggcagaaccttgtactacgacaggtgttcggagggatggaggaaggattcctgggtctgagctgggctttgaaggtctaccaggagtttgcta

SEQ ID NO: 281555 - DNA, 936 bp, Homo sapiens
cttgtgccacttgctgtaccagctgtcctcatcggtgacgagcgggaggtaaagaaattgatggtccaagaggttgactgatctgttcggagtcacatggcttatgagtagtcaagcaggaacatccctcccaggactcactcacacctattctccaactctgcctacctgctcaattcacctgatgctctgccagtggattgctgatgtctctacattgattcagatttgcacccacatctgaaaatggtcagcaggcagggaccctctgtcaccacaggtggaggaagaggagatgaaagagccttgtctgacaccctggagactgtgggttcctgataagaggttgaggatcaggcccctttctctctccctcatgctctcttgcctttccacctaccaccattggatgatgcagcaagaaggcccttgccagatgtgggcccctccatcttggacttcccagctagcctccagaactggaaactacccagactgtgtcctctccctcttactctcctaaaggaagacaaggaagacaatgacaaatggcgtttgcagcaaagcaacaccaacagccaacttgatgctcaagagagaacgctatgcctcttcctcatggtttccagtgctctacacattctgagaaacttttctggtaataaactatagaaacaatgagactgtgcccatgggagagaccccatctctacaaaaaatacaaaaattagccaggcgtagtggtgtgcacctggattccccagctacttggaaggctgagatgggaagatcacttgagccccggaggttgagactgcagtgcgccatgatcacgccactgtacttcagcctcagtgacaaagcgaaagcctgtttcaaaaaaaaaaaaagacagagagaaacgggctggggacggtggttcacacctgtaatccc

SEQ ID NO: 281556 - DNA, 783 bp, Homo sapiens
cttgtgccacttgctgtaccagctgtcctcatcggtgacgagcgggaggtaaagaaattgatggtccaagaggttgactgatctgttcggagtcacatggcttatgagtagtcaagcaggaacatccctcccaggactcactcacacctattctccaactctgcctacctgctcaattcacctgatgctctgccagtggattgctgatgtctctacattgattcagatttgcacccacatctgaaaatggtcagcaggcagggaccctctgtcaccacaggtggaggaagaggagatgaaagagccttgtctgacaccctggagactgggaaactacccagactgtgtcctctccctcttactctcctaaaggaagacaaggaagacaatgacaaatggcgtttgcagcaaagcaacaccaacagccaacttgatgctcaagagagaacgctatgcctcttcctcatggtttccagtgctctacacattctgagaaacttttctggtaataaactatagaaacaatgagactgtgcccatgggagagaccccatctctacaaaaaatacaaaaattagccaggcgtagtggtgtgcacctggattccccagctacttggaaggctgagatgggaagatcacttgagccccggaggttgagactgcagtgcgccatgatcacgccactgtacttcagcctcagtgacaaagcgaaagcctgtttcaaaaaaaaaaaaagacagagagaaacgggctggggacggtggttcacacctgtaatccc

SEQ ID NO: 281557 - DNA, 846 bp, Homo sapiens
cttgtgccacttgctgtaccagctgtcctcatcggtgacgagcgggaggtaaagaaattgatggtccaagaggttgactgatctgttcggagtcacatggcttatgagtagtcaagcaggaacatccctcccaggactcactcacacctattctccaactctgcctacctgctcaattcacctgatgctctgccagtggattgctgatgtctctacattgattcagatttgcacccacatctgaaaatggtcagcaggcagggaccctctgtcaccacaggtggaggaagaggagatgaaagagccttgtctgacaccctggagactgcaagaaggcccttgccagatgtgggcccctccatcttggacttcccagctagcctccagaactggaaactacccagactgtgtcctctccctcttactctcctaaaggaagacaaggaagacaatgacaaatggcgtttgcagcaaagcaacaccaacagccaacttgatgctcaagagagaacgctatgcctcttcctcatggtttccagtgctctacacattctgagaaacttttctggtaataaactatagaaacaatgagactgtgcccatgggagagaccccatctctacaaaaaatacaaaaattagccaggcgtagtggtgtgcacctggattccccagctacttggaaggctgagatgggaagatcacttgagccccggaggttgagactgcagtgcgccatgatcacgccactgtacttcagcctcagtgacaaagcgaaagcctgtttcaaaaaaaaaaaaagacagagagaaacgggctggggacggtggttcacacctgtaatccc

SEQ ID NO: 281558 - DNA, 415 bp, Homo sapiens
aggctctggagccaggccgagccctgcgcctcctcgtgaggatgcctgagccccctcccagggtacttcaggcagagacagtggcccctgggggccctacccctctccccctcctcacactgtctctaaggccctagctattgacagatgtggccacatccactttccctcctccacagaagtgactttcctgagtttctctctgtcctgggaagagatgttttatgcacagaaatgtcactgcttcctggctgacatcatcatggattccatcaggcaaaaggaccccaaagccatcacagccaaggtggtctccctggccaatcggctgtgggtatgtgtgacaggcctcaggccctggggcaccctgtaccttctccacctcttcccctgccccacaataagtggtgcaagg

SEQ ID NO: 281559 - DNA, 750 bp, Homo sapiens
ggcaccctgaaggactggagcaagcagaggaccaaggagagagaaagccctgcccctgagcagcctctgcccgaggccagtgaggtggacagcctaggggttatcctcaaagtgactcacccccccgtggtgggcagcgatggcttctgcatgttctttgaggacagcatcatctataccacggagatggacaacctcaggcacacaacacccacagccagtccccagccccaagaagtgactttcctgagtttctctctgtcctgggaagagatgttttatgcacagaaatgtcactgcttcctggctgacatcatcatggattccatcaggcaaaaggaccccaaagccatcacagccaaggtggtctccctggccaatcggctgtggaccctgcacatcagccccaagcagtttgtggtagatttgctggccatcaccggcttcaaggatgaccggcacacccaggagcgcctgtacagctgggtggagcttacactgcccttcgccaggaaatatggccgatgcatggacctgctcatccagaggggcctgtctaggtctgtctcttactccatcctgggaaagtacctacaagaggactagggtgcccagagatgcagcccctcatgccccacccgccaagtctcattttaattggagatagcccagaatgcatgtgcccatcagagggtacatatcagtctattttttattataaacaaataaaagattaaatcacacatcaaa

SEQ ID NO: 281560 - DNA, 524 bp, Homo sapiens
atttaatccacagaacaactcctggtggagccatcgttagcccaattttacagctgaggaaaccgacatgcacagaagttacgcacattggatcaggccacacagctggaaacccagatgagcaggaagacacgcgctcggggctggagacgtgcacacctggggaaggaggtgcacagcccgcgtcctcagttcctccgcaaagtcagcttcgccgcagcccacctcccacccaggaccggccccaaagcccttctcgattacctcgaaaggatctccggcactgaagtcgaaggagaggatgaggtgaacctcccgcgtcgggggcagcacgagtgggaagggagtgttgatggctaaaccagcatccaccaggtggaggtgcttccggctgctcattatcttgtcccggatgccacctgtggtgcccaggaagaaagaggatcagctgcttctggggactgaaagcaagacttggaaatggaaggcagagagggggatgggaaaatgatcgttgtcagtgt

SEQ ID NO: 281561 - DNA, 236 bp, Homo sapiens
atatgttctcactcagcaaacatttattgagggccactatttgcccaggaaacccagatgagcaggaagacacgcgctcggggctggagacgtgcacacctggggaaggaggtgcacaggtgaggagctaggctgttgcagttcaaactggtatgaatgggcaggcaggacgcagaagcggggagagtcatctgccaggaagaggggcccgggaaggtctgggatggctttggatc

SEQ ID NO: 281562 - DNA, 452 bp, Homo sapiens
aactcttctagacaaagccaggtccagctggggagtgacggggaggccactctgctggccaggctgaccgagggctgcagggcacagcagagcctggcagggctggggtcacaggcactgcccagggctccttgggcctcccttccacagctgagaagacctctccacggagctccggacggctggggtctggctctgaggagccatgagcacagagggccccagcctcgccagctccccagccatcagccccctcgcctttctctcagctcccgtcactcccgggacccttgcagaggcaactgaccccctccccatgctcatcgccctggcctgcatcttcctcctgctggccacctgtctgctgttcatgacgctctgcaagccggccgcgctggacccgagccgccgcagggctcacgagtgcatgccccaccaccctgggagcccca

SEQ ID NO: 281563 - DNA, 539 bp, Homo sapiens
cttgattcccaggctggagtgcagtggcacgatcttggctcactgcagtcgccacctcccggattcaagcaattctcctgccccagcctctcaagtagctgggattacaggcgcccaccaccacacccggcaaattttgtatttttagtagagacggggtttcatcatgttggtcaggctggtctcgaactcctgacctcaggtgatccatccacctcggcctcccagagagctgggattacaggcgtgagacaccgtgcccggcaaaaatattttaaaataagtcagaggtgcaggtttaatccaaatcccccatcagcctcctggtcctgggacaaatattgtctgcaccgtgctcacacacacagacacccaccggacacactcgcttggaggcccaggacatggggaagttgggcccagctgtgtcaaaggccaatcctgcccctccttgctgtgtgacctcaggcaagcaactgtcctctctgagcccgagcctgcctgaccccctgcttttcactctagcaagaatgctgtgg

SEQ ID NO: 281564 - DNA, 1344 bp, Homo sapiens
acacttaacaggacttcggcattcccctgaatacagactagatcagagattttatttttttaattgaaaagtaacttgggttctctttagaaacccttatttggtgtgcgcatctggctatttcacagagatttcagttttgcaaagaagtcggagttgatttcttccctcagacaagctattggttgttggtgggcaacagaagttgctcagcatagacaggggaaaaaacggttacggatgagactgaaagaaaacctcaaaggagaactctgagaattcatctcaggatgaagctgcaagggcaaaggagaagtacttgtgacacaagcaaatgggtccattgatcaacagatgcaagaagattcttctcccaactactgtacctcctgcaacgatgagaatctggctccttggaggcctgctgccattcctgctgctcctctctggcctgcagagacccacagagggttctgaggttgcaattaaaatcgacttcgacttcgcaccaggttcttttgatgatcagtaccaaggctgtagcaaacaggttatggagaaactaactcaaggggattatttcacaaaagacatagaagcccagaagaattattttaggatgtggcaaaaagcccacttagcctggcttaaccaaggaaaagttctaccccagaacatgactaccacacacgctgtggctattttgttttatacattgaacagcaatgttcattctgactttactagagccatggcctctgttgccaggactccacagcagtatgaacgttcattccacttcaaatatttacactactacctcacctcagcaatccagctgctgaggaaagacagcatcatggagaatggcactctgtgctatgaggtgcattataggacgaaggatgtccactttaatgcctacacaggggccaccattcgatttggccaattcctctccacatccctcctgaaagaagaggcacaggagtttgggaaccagacactatttaccatattcacctgcctgggtgcacctgtacagtacttctccctcaagaaggaagtcttgatccctccctatgagctgtttaaagttataaatatgagctaccacccaagaggagactggttgcagttgaggtcaactgggaacctgagcacatataactgtcagctgctaaaagcttccagcaagaaatgcatccctgatcctatagctattgcatctctctcctttttgaccagtgtcatcatcttttccaaaagcagagtataaagaaatcttgtggctccttttatttaaaaaaaatatttaaataaaatcttttttattggcttttg

SEQ ID NO: 281565 - DNA, 1533 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281566 - DNA, 1796 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcaggtatgtattcaaccagtggtgggcaggagtccccctagtaatgaggagaggttctatgctgaatttgggtcttaagacattgtgagccttgattcagagataatatttctcttgtgtagacaaaagctattcctttaatcctaccccaaaagaaagagtccaatgtgtacttcctttgcccacttcactgtctcagccccatcctccccagcccccaagcccctacccagtcacatctgcgtgtccacttgatccacctgcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281567 - DNA, 1493 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacatatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281568 - DNA, 1233 bp, Homo sapiens
tcggctaggtggaggctggtgtgaatcggccgaggcccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281569 - DNA, 1913 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcaggtatgtattcaaccagtggtgggcaggagtccccctagtaatgaggagaggttctatgctgaatttgggtcttaagacattgtgagccttgattcagagataatatttctcttgtgtagacaaaagctattcctttaatcctaccccaaaagaaagagtccaatgtgtacttcctttgcccacttcactgtctcagccccatcctccccagcccccaagcccctacccagtcacatctgcgtgtccacttgatccacctgcagaacttcaccatgggagatctacatcactttgcatcctgccactgcagaggaccaggattcacagtatgtctgcttcactctggtgcttcaggtcccagcagaggtgaagcccctactgtgtggcagcaaagggaggaaggggagagtccctggggtggatcacttcagcagtaacttgttatttgcccccactagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccagtgccctacatctgccttccctctaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281570 - DNA, 1008 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacaccgtcacgaacgtatacaccgtcgacatcgcttccacctaggggatcctctaa

SEQ ID NO: 281571 - DNA, 165 bp, Homo sapiens
gttagtctactcctgtctctctagggtccttccctctgaagttgaagtattggagtccatctatctagatgaactacaggtgattaaaggaaatggcaggtatgtattcaaccagtggtgggcaggagtccccctagtaatgaggagaggttctatgctgaattt

SEQ ID NO: 281572 - DNA, 1566 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttctttggctttctttgcttagcagcgcctagcctg

SEQ ID NO: 281573 - DNA, 1888 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcaggtatgtattcaaccagtggtgggcaggagtccccctagtaatgaggagaggttctatgctgaatttgggtcttaagacattgtgagccttgattcagagataatatttctcttgtgtagacaaaagctattcctttaatcctaccccaaaagaaagagtccaatgtgtacttcctttgcccacttcactgtctcagccccatcctccccagcccccaagcccctacccagtcacatctgcgtgtccacttgatccacctgcagaacttcaccatgggagatctacatcactttgcatcctgccactgcagaggaccaggattcacagtatgtctgcttcactctggtgcttcaggtcccagcagaggtgaagcccctactgtgtggcagcaaagggaggaaggggagagtccctggggtggatcacttcagcagtaacttgttatttgcccccactagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281574 - DNA, 1100 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaagttacccactccacttcctccagaacccct

SEQ ID NO: 281575 - DNA, 1558 bp, Homo sapiens
aaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccagtgccctacatctgccttccctctaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281576 - DNA, 806 bp, Homo sapiens
agcctccgtggcctccagcagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttc

SEQ ID NO: 281577 - DNA, 2810 bp, Homo sapiens
aattcccagaccacaggaatacctaatgccttttttctcttcctgtctttgtccctcacactacagcggcccctcccttccctcttcaacctcatcctccctccccacaggcccagagaaccagttgggctttgttctcctgcaggctatggttcatcatgcaaatagctcctgtgtcagaaatgctttttggcttcaaataacagaaaagctaacaccagctttatcaataataatatcggtggtttacttaaggtgtccagagatggtggagaacaggattggtttcctcctcaatgtcaaggactcaaagactctttctgtggtagggccacatcctaaaccctgtatcctgtgattatttacccgacagggcaaaagagattttgcagatgcaattaaggttaaggaccttgacgtgggaagattgtgattatttacctgacagggcaaaagagattttgcagatgcaattaaggttaaggaccttgacgtgggaagattattctggattatctaggtgggcgcaatttgatcacatgggtccccagaagtggagaacctttcccacctgtagaaagccagagagctggcacctgagaaggacagaactgtcattgcaggatttgaagatgaaggggcccatgagccaaggaatgccagtgacctatagaggctaaaaaacagcaaggaaatggactctccccagagcctccagaggaatgcagccctgttgatcacatgatcaccagatggctgccccagagccaaatgtcgcttcctgagcaccatactcaaaggcaggggaagtggatggagggcaggagctccattcttgtttgccactctccttttgtcaattgggaaaaaattccagaaactctgggagccctccccttacatttcctgggtcatggggccagccctagctgctggagggactgagaacagctgttgagcagtttacctgacggcatctgccatggcttggcaggaactctggctttgggagagagcagcagcaaggtattcaagcaccacctccacccagcccctcccacatttcactcaggactgagtaaaggagacactcagatgctactcagatgctggcttcagctaagtattttgcaaagcctctcgtgtcttacaagtttgtggctatcatgacaaaatggagcagcctactatatctacatatacaactatgggggacctagttttatctcatttaccacaatgttttcaatcattttttggatgacataatttttagcctcttctctaaatgcttcctcaagctttccttgccttccagccactgcaaatgacttgcagtttcccctacatggcacctgacccttgtgcctccctccctctgcccatgcccagaaagccctttcctgtgccctctggcttcctgataaactcctatcatcttcaagagccagttcccatgccagctctccccaagtgctccactgaggcttccgtaacacctctgttcccacatcgggttgactgtctttgttttgtcattgcttgctctggctgtgtctccctcattagactgggatgccttcaaggtagggaccctatctgggtcagcttggcaccccaaagcgtaccacagcacctgattctgaggaggctctcagtagatatctgttgagtaaccagaatgtagggtggtcctgatggtttctgacattgaatagaaaacagctccctatttgatcttaaaataatcactataacctggacatactgtactagatgctgtttttgtctgacttctactctgtcaatctctttgcacctccatttgttcatctgtgaaatgaagaaaatgctcatggagttcagtgaagattaaatgaatgaatataggtagactgcctaatctggcacttgccacgcagctgacttcaatatagtagctctaatattatggtccttgaggatcttactgtcttatggcccagaactgcatttgattaaagaaggctcccctaaaaaaagagtcatacatattccatttgtcctttcagaaggccgtgaagcatttacactctttaagacaaattcccatccaaaaatagttaagatttctaaaatattttgatgctgaaagaggtgtgcttcagttgggtggcaaatttgcttctatggaagatttttaatacaggttgtttctattttactttttctggctgaaaggattttacatttattcaaagtcaaaagggaaaagaaatccaagaactacagaagagcagttgaagtgatttatgcttgatttctaaatgcaacttatgtttatacataatttaaaactcaaagaaagcatgcttatacaatcatgtgcaactttaaactttaagaactctggatgaatacatggtggcaacagtccatgacacctgaaaacatcatttgtggagtggcgtagagttcagtgttcgcagtcgcatattacaaccatgtttcacacagccctgctcggtttgattttctccacgtggttgataattgtcttcagttgctgctaagtgattttgcaaatttcatttataatcctcgccctacaattacctaagtactgtttctgcaggttaacctgtatgctacgctcagtcatatacctttcaaagttactaatgcaactgccaaagagggacagtgtcaatatcattgtcttcattagaaggacggctgccccacactgtgagaacactgctgttcctaacagtagtttacttttagagggatgtgagaattagtttgaccttaattccagatgtgcatgc

SEQ ID NO: 281578 - DNA, 691 bp, Homo sapiens
aattcccagaccacaggaatacctaatgccttttttctcttcctgtctttgtccctcacactacagcggcccctcccttccctcttcaacctcatcctccctccccacaggcccagagaaccagttgggctttgttctcctgcaggctatggttcatcatgcaaatagctcctgtgtcagaaatgctttttggcttcaaataacagaaaagctaacaccagctttatcaataataatatcggtggtttacttaaggtgtccagagatggtggagaacaggattggtttcctcctcaatgtcaaggactcaaagactctttctgtggtagggccacatcctaaaccctgtatcctgtgattatttacccgacagggcaaaagagattttgcagatgcaattaaggttaaggaccttgacgtgggaagattgtgattatttacctgacagggcaaaagagattttgcagatgcaattaaggttaaggaccttgacgtgggaagattattctggattatctaggtgggcgcaatttgatcacatgggtccccagaagtggagaacctttcccacctgtagaaagccagagagctggcacctgagaaggacagaactgtcattgcaggatttgaagatgaaggggcccatgagccaaggaatgccagtgacccccttctgtcgtcttttggcagc

SEQ ID NO: 281579 - DNA, 642 bp, Homo sapiens
ggactatgtttgaggggtgttgtatgaccccgttttccatacccagccaacttgtcatgtgacaagtccacagaaagatgttatatgacaggaatctatgaactagtcttccctgaaatgtacctgactacagctaacatcatatcacatgatgaaagaccgcgttgttttcccctgaggttggcatggggacctattgctcacaggaagaaaaaaacatcgtccttattttgtgacttctggcaactgtctttttccgaggaagccccttcccttctgccctgcctctgagttcaagccgggatgcagctcctagtgttttcaagcgtcttacagatggagatcagccccgtcttcctccaacgtccccaccccgcatcggagtcaggactccacggtgctgtggtcagcacggctgcatggtcctgcgaccctgagccccagtgggctctgactgtggttaccagcgccttaggagacagagtaacagtctggaagcagaaacagagactgtccatttcataaacagccacatccgcaaggtttattcctggatcacaaaccaaccccactgaccaaactcccaagtcactttatattaaacttgttatcaaatcacccacataaatatatataataaaa

SEQ ID NO: 281580 - DNA, 6980 bp, Homo sapiens
ctcttgtgctctcctctagttttactgaactgccagtactttgaacacactttgtgctttttctcctccaggtctttgtgcatactgtttcctctgcctggaatactcttctttctctttacctgactcgtttctgctcttacttcaagtctcagattctaggaagctttccatcaacctgctatcactgggacgagttggccatcccctgtgcttctgtagctcctatgaaatcataatagttgaaatgtgatgtttaaatgtttacttggcattctcctctactgaactctaagctttgtgagggtagtgatggtggctttgcctattgttttgtttcccttaaatctaaacgcagtgcctggcacatagtagcctccagtaaatgcttgtttaatgaacaaacaaacctgtgaagtgagtgatagagtgcttagtccccttcagttttcaggatggagagatggagaataaggacctcacacaaaatcacacagtacttggtggaagaagctgagctatgacctgccttccttcagaggaatgcactttgctttggaagatatgaagaaattcccagtacattgtctttcctattgggtctgtgtgagaacaggctgatagatgcctctgtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaaaccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcagagcagtgtgggtgtgggcgttgtggaggggaagctatatgctgttgggggttatgatggagcttcccgccagtgtctgagcactgtggaacagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggtcttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaacgtttgtatatttctgagccagatcctttcaaagattgcctttttataaaattgaagctatagcttttaggctaaaattttaacgtagatatttttataagatatttttttcaagagtttgaatcgctttttattgtccatggtaatgaaatgttgtgttctttgcatcattcactctcaaacgtagttcatgcctgtagctctcttccttttgtttctcacccttcagaaacatatttttcagtagctccaggtagatgagcctttttttttttttttttaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccgtcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 281581 - DNA, 788 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagagtctcgctcttttgcccaggctggagcgcagtggcgtgatcttggttcactgcaacctccgcctcccaggttcaaggaagtctcctgccacagcctcctgagtagctgggattacagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaaagacaggatcttgccatgttgcccaggctggagtgcagtagctgttcatat

SEQ ID NO: 281582 - DNA, 740 bp, Homo sapiens
tttttagctcgtggcacaaaatcctgatggactccacgaaagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagatgcttcctcttctctcaatatattctcacttatgggtataaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtaaaaaccagaaactgtgggcaagcaaaaagtaaaaaattacgtgtactacaacatctaggtaagagtatgg

SEQ ID NO: 281583 - DNA, 353 bp, Homo sapiens
ggccaagtcttggatgcccaagcccaaattcctaaccgtgaccctacgctgctgctgctgctgctacttgcagaaactggttattaaccgagagctgttgctggaagtagcttccactcccctgcccccgtgatgtaaaaatagatgaaaaactctgcagtgattatgtgaaaggtcaggccgacacaggagtcctggggcccagacccacatctgacccagaagctttgcaaagatgagaaggttggtaaaccagctatagaaaaggccaaactaatttggctgtaaattaaggcagccaaaagccctccaggatgtaagaccaggacggattctcgtgttgataaaaagga

SEQ ID NO: 281584 - DNA, 7102 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagatgcttcctcttctctcaatatattctcacttatgggtataaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaaaccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcagagcagtgtgggtgtgggcgttgtggaggggaagctatatgctgttgggggttatgatggagcttcccgccagtgtctgagcactgtggaacagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggtcttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaacgtttgtatatttctgagccagatcctttcaaagattgcctttttataaaattgaagctatagcttttaggctaaaattttaacgtagatatttttataagatatttttttcaagagtttgaatcgctttttattgtccatggtaatgaaatgttgtgttctttgcatcattcactctcaaacgtagttcatgcctgtagctctcttccttttgtttctcacccttcagaaacatatttttcagtagctccaggtagatgagcctttttttttttttttttaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccgtcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 281585 - DNA, 7520 bp, Homo sapiens
  misc_feature (7127)..(7136): n is a, c, g, or t
  misc_feature (7138)..(7138): n is a, c, g, or t
  misc_feature (7142)..(7142): n is a, c, g, or t
  misc_feature (7144)..(7144): n is a, c, g, or t
  misc_feature (7150)..(7151): n is a, c, g, or t
  misc_feature (7164)..(7164): n is a, c, g, or t
  misc_feature (7168)..(7169): n is a, c, g, or t
  misc_feature (7176)..(7176): n is a, c, g, or t
  misc_feature (7178)..(7179): n is a, c, g, or t
  misc_feature (7193)..(7194): n is a, c, g, or t
  misc_feature (7204)..(7204): n is a, c, g, or t
  misc_feature (7207)..(7208): n is a, c, g, or t
  misc_feature (7222)..(7224): n is a, c, g, or t
  misc_feature (7228)..(7229): n is a, c, g, or t
  misc_feature (7282)..(7282): n is a, c, g, or t
  misc_feature (7290)..(7290): n is a, c, g, or t
  misc_feature (7297)..(7297): n is a, c, g, or t
  misc_feature (7321)..(7321): n is a, c, g, or t
  misc_feature (7340)..(7340): n is a, c, g, or t
  misc_feature (7424)..(7424): n is a, c, g, or t
  misc_feature (7454)..(7454): n is a, c, g, or t
  misc_feature (7488)..(7488): n is a, c, g, or t
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagatgcttcctcttctctcaatatattctcacttatgggtataaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaaaccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcagagcagtgtgggtgtgggcgttgtggaggggaagctatatgctgttgggggttatgatggagcttcccgccagtgtctgagcactgtggaacagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggtcttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaacgtttgtatatttctgagccagatcctttcaaagattgcctttttataaaattgaagctatagcttttaggctaaaattttaacgtagatatttttataagatatttttttcaagagtttgaatcgctttttattgtccatggtaatgaaatgttgtgttctttgcatcattcactctcaaacgtagttcatgcctgtagctctcttccttttgtttctcacccttcagaaacatatttttcagtagctccaggtagatgagcctttttttttttttttttaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccgtcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaaaaaaaaaaaaaaaaaaaaacccccnnnnnnnnnntngggntntttttnnaataaaaaaaaanaaannaaaaaanannaaaaaacctacccnntcggatcctnccnnaaaaaacccatgtnnnttanncgctttgggtttaaaaaaaaggccaaggtaaaggcccgggcctttccggcccnctattttngggttcnctcgtactttttttggctcatggnccagccgcacaacttttgnaggctcgccggcccatgtggggtctttctggcggcgcgccgctgccagcctccctaaagcgcgggggctggagttgttgagcancccgccgctgtggtccatgtagccgctggncgcgcgcggactgcggctcggcgtgcgcgtgttnccggccgtcccgcctcggcgagctccctcatg

SEQ ID NO: 281586 - DNA, 1817 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagagtctcgctcttttgcccaggctggagcgcagtggcgtgatcttggttcactgcaacctccgcctcccaggttcaaggaagtctcctgccacagcctcctgagtagctgggattacaggaattctcaagggtctctttggaggcttaccaaggacatccagctgcacagtgaaggtggcttctcctgctctattcttggcaacacatgcataagcccctgcatctgaagctctgactacttcaaagatgagtgaatgaagacccttctcagacactatcattttgtgcaaatcatctgattgaactgttcttccatttagataccatgacacatcaggagctggcagtccactcacctagaaagaaaaacacaaggagatggcagaattttaaagtattgcatcactgaaacctatttgtccatatatgaatttaaacagttcccgtatctgagtgggtttgcgattgaaatgcaaagcaagagctcaaaagtatttataattttttaaacaaaacattggaaataagatccttgaaattaacatagtatttttagactgtctcaaaccataactcttttacatgcaacctcagtctctttatgaactcttaatttctatatttagaacattaatttatgttacattggtttccataaggaatatagaagtcattgcttttctggctaaatgtgactgcaaatgaagtcccagaggcacatatatatgaggcttcctgatctaatgcgtaatttttctaaaacagagtgttcttgagctatagtttggcatataaatggcaatttgttaagtgtttttacataaactgttaacagtggaatccaaagctttaacactaacttgagttcataaggaatctggaaaaaaaattttataaggaaaagttctccaaaatgaggataataaaaatataacctcttctaaagagcttttctagtctgagggactcttttaggccaagagaaagcagggtggcttgaatttcttgatagaggagaattggagagacattatactttaaggctgggcacagtggctcacgcctgtaatcccagcactttgggaagccaaggtgagtggatcgccttgaacccaggagttctagactagctgggcatggtggcacgcgtcttgcactccagcctggatgacagagtgagagtctgtctcaaagataaataaataaataaaaatatccaaattaagtttttgacgtttttctatagtggtggtgtgaacatgtatatagttatattcagagatgtggtatttcagttataccaacctccgcttcttgggttcaagtgattctcttacctcagcctcccgagtagctgggattacaggcatgtgccactacgcctggctaattttgtatttttagtagagatggggtttcactatgttggtcagcctggtcttgaactcctgacctcaggt

SEQ ID NO: 281587 - DNA, 1699 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcaggaattctcaagggtctctttggaggcttaccaaggacatccagctgcacagtgaaggtggcttctcctgctctattcttggcaacacatgcataagcccctgcatctgaagctctgactacttcaaagatgagtgaatgaagacccttctcagacactatcattttgtgcaaatcatctgattgaactgttcttccatttagataccatgacacatcaggagctggcagtccactcacctagaaagaaaaacacaaggagatggcagaattttaaagtattgcatcactgaaacctatttgtccatatatgaatttaaacagttcccgtatctgagtgggtttgcgattgaaatgcaaagcaagagctcaaaagtatttataattttttaaacaaaacattggaaataagatccttgaaattaacatagtatttttagactgtctcaaaccataactcttttacatgcaacctcagtctctttatgaactcttaatttctatatttagaacattaatttatgttacattggtttccataaggaatatagaagtcattgcttttctggctaaatgtgactgcaaatgaagtcccagaggcacatatatatgaggcttcctgatctaatgcgtaatttttctaaaacagagtgttcttgagctatagtttggcatataaatggcaatttgttaagtgtttttacataaactgttaacagtggaatccaaagctttaacactaacttgagttcataaggaatctggaaaaaaaattttataaggaaaagttctccaaaatgaggataataaaaatataacctcttctaaagagcttttctagtctgagggactcttttaggccaagagaaagcagggtggcttgaatttcttgatagaggagaattggagagacattatactttaaggctgggcacagtggctcacgcctgtaatcccagcactttgggaagccaaggtgagtggatcgccttgaacccaggagttctagactagctgggcatggtggcacgcgtcttgcactccagcctggatgacagagtgagagtctgtctcaaagataaataaataaataaaaatatccaaattaagtttttgacgtttttctatagtggtggtgtgaacatgtatatagttatattcagagatgtggtatttcagttataccaacctccgcttcttgggttcaagtgattctcttacctcagcctcccgagtagctgggattacaggcatgtgccactacgcctggctaattttgtatttttagtagagatggggtttcactatgttggtcagcctggtcttgaactcctgacctcaggt

SEQ ID NO: 281588 - DNA, 1627 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagatgcttcctcttctctcaatatattctcacttatgggtataaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaagatggagtcttgctctgtcggccagggctagagtgcgatggtgtgatctcggctcactgcaacctccgcctcccagtagagacagggtttcaccatgttgaccagactggtcttgaactcctgacctcaggcaatccgcccgcctcagcctcccaaaatgctgggatgacaggtgtgagccaccatgcttggccaatcttttcttttctttcagagaaaaacaacagcttttttttttaatccctttaaaa

SEQ ID NO: 281589 - DNA, 835 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagtgagtactatgttgtaatttcttaagagccctgaattagggaacttgggccaaaatattaactctgccactggctgattgaagctggttataggaacttggaaaagactattaacttctctggaactcaggttctttgtctatgaaatagggctagcaaaatatgtggggttttgaggttcatttcacaaaggtctgaaaacttcctgtaaagag

SEQ ID NO: 281590 - DNA, 829 bp, Homo sapiens
tggctgtaaattaaggcagccaaaagccctccaggatgtaagaccaggacggattctcgtgttgataaaaaggaaaataaaatggaatccagtccaaaggccccagggaaacctgcaaagaaaaccactaaccagttttgaaagtaaaagataaagccacttttgttatttccctgaaagagatgtagactgctgtcgataaatgctgttttatgtgtagataaaaagcaaaacggccacacagtagtgagggtcaaaaactaccatcgatgagaggaacaggagaggcctcgcaaaaggctgacagccagtgaactagaagcccgagaggaaaaaaagctttagaatagttttaacaaaaggatttgggctttcctgtactgggactctcagctgttcacaaaattatgctttctaaagtaacagattatctgaaattgaaattattagaggaaaaacacccatatataggtaatcaaatttacataatttttttttttttagagatggagtctcgctatatttcccagtctggcctcaaactcctgatcttaagggatccccagctcaacctctcccagcagctgggactaccgggctgtcaaatttacattaactatgagaattaagcaggtaatctctagagactattcttattcctttgagcataacagactgaaaaatcctgaagaattagaaacctgtttggttaaaacaaaatcacaaattcagtagattcagtcatgatttaagttcttgtgattgcctttgaagtgcaaaccatggcaagtctagcttagtttctagaggaattggctgagctgtaagt

SEQ ID NO: 281591 - DNA, 6810 bp, Homo sapiens
tgcctgattctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcagctgaaagggctgcagggagctctgggtaagacattttctgttgctgctgcttttgcggtagaagctgctgcgagtaagtcagaggaaggaggattgagaagggaggaggcttcacttgcagccatgctgaatcactgttgctgatcagatttcccactggtctgctgggagaatcaagaacagaactaggatccccgagtgcatacacagttcagcagctaccaccctggctgggcctcacacaatggagggtgaaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaaaccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcagagcagtgtgggtgtgggcgttgtggaggggaagctatatgctgttgggggttatgatggagcttcccgccagtgtctgagcactgtggaacagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggtcttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaacgtttgtatatttctgagccagatcctttcaaagattgcctttttataaaattgaagctatagcttttaggctaaaattttaacgtagatatttttataagatatttttttcaagagtttgaatcgctttttattgtccatggtaatgaaatgttgtgttctttgcatcattcactctcaaacgtagttcatgcctgtagctctcttccttttgtttctcacccttcagaaacatatttttcagtagctccaggtagatgagcctttttttttttttttttaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccgtcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 281592 - DNA, 6840 bp, Homo sapiens
cataagattccattatatatactctaattgaaaattcatttccttcgttggaaattatagttttatgtaatattttgttattataaataatgatataatgggcatccttgcatcttaatctttatgtacattcctgattattttactagaatagattcctagaataagaagtactcgattaaaaggtatgcacactttgaagacttttgagacatgtgccgcattgatctaaagaacagttgtaccagcttatgctcccatcagcaagatatctaagatttatatatttttaaggcccattggctttgcctaaaccttggtaaacagatactaaaaatctccagtaacattgcaaaattttgttctaattatcaggttcagcttcaaaacgtgtaaaatgcattgtgtactgagagtaagaggctgactctcgttagatccatttctatcagtgtgtttaaagccaaaaggaaagtaaaatacacatggctttcttctgacttgagttgtgtgattatggtcttttactcaagcttaaatgtttttatttttttgtcttccgagttcatgttgcccaaatgtcctgaggtggttccaaataccaatcccacacttcttgaccattgtcctgtggacaataacttggaataaatgtgaaactgaagtctgagtgcccatcagagagtgtcccaatccaaccagtctataagaagatctggggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaaaccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcagagcagtgtgggtgtgggcgttgtggaggggaagctatatgctgttgggggttatgatggagcttcccgccagtgtctgagcactgtggaacagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggtcttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaacgtttgtatatttctgagccagatcctttcaaagattgcctttttataaaattgaagctatagcttttaggctaaaattttaacgtagatatttttataagatatttttttcaagagtttgaatcgctttttattgtccatggtaatgaaatgttgtgttctttgcatcattcactctcaaacgtagttcatgcctgtagctctcttccttttgtttctcacccttcagaaacatatttttcagtagctccaggtagatgagcctttttttttttttttttaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccgtcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 281593 - DNA, 7212 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagatgcttcctcttctctcaatatattctcacttatgggtataaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaaaccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcagagcagtgtgggtgtgggcgttgtggaggggaagctatatgctgttgggggttatgatggagcttcccgccagtgtctgagcactgtggaacagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggtcttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaacgtttgtatatttctgagccagatcctttcaaagattgcctttttataaaattgaagctatagcttttaggctaaaattttaacgtagatatttttataagatatttttttcaagagtttgaatcgctttttattgtccatggtaatgaaatgttgtgttctttgcatcattcactctcaaacgtagttcatgcctgtagctctcttccttttgtttctcacccttcagaaacatatttttcagtagctccaggtagatgagcctttttttttttttttttaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccgtcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaacttttctcagtatttcatttctatagtccagtctctctgctatgtctcaaacatgaaaaggacagacttattcctgtatgtctttggattaaaaaaatttttaagatcta

SEQ ID NO: 281594 - DNA, 1480 bp, Homo sapiens
cggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagatgcttcctcttctctcaatatattctcacttatgggtataaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcgtttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaagatcttttcttttctttttttttgagatggagtcttgctctgtcggccaggctgagattgcaccactgcactccatcctgggcaacagagtaagactctgtctc

SEQ ID NO: 281595 - DNA, 1389 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtactagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaa

SEQ ID NO: 281596 - DNA, 1156 bp, Homo sapiens
aggctggtaccggcccgacgtatgggatcccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaa

SEQ ID NO: 281597 - DNA, 1103 bp, Homo sapiens
cttatttgccacatgaaacagatttaggcattattaccaaggacatttttcaaaatcatatttcagaattattgcaggaaaacatctggtgataaagaccaaatagtttattggcagctccaggaaccctctcctaatgcttgccttcttggaacacttatgttattgaactgagtaagaggactgtcttaaagttctaatgacatactgccaaaattcaaaacctttgagattgaaccagaacttcagaaaaacagatggatacaattgatgactgttttagaatagcagatcaattttatttcaatttctatttgtgcatttggcttcattccctttattaaattttcaaatataactaaatgtgtacatttggtaagtcgttgggaaataataagaatgctttgctaaagtgatggttttgtgcttttcctaggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaa

SEQ ID NO: 281598 - DNA, 1678 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaaaaaaaaaaaaagggggggcggtcggatttagaaccagagctcaggaaatagaaccgtctgaatatcctgccggcatatcctagtctaatggacctccaatcctaagatcttacataacggaggggcaaggtcctcccttacctaataatggccaggtttgacctcggtccgaagggggaattaatctaattcca

SEQ ID NO: 281599 - DNA, 1879 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaactttgtggcccttttggcccaagcgattttaaatttgggcaagtttttgcatggggcccaaatttgggcttatttggccaatttccccttaaggggggcgttttacaattcaatggcccgggttttaaaaaggtgggatttgaaaaaccctggggttccccaatttaaaccctttggaagaaaatccctttttgccaagttgggttaaacgcaaagggccccgaccgaatcgccttttccaaaatgttggcaaccttaaatggaaagggaaattggaaggcttaaatttgtgtaaaattccggt

SEQ ID NO: 281600 - DNA, 1223 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagaggtgaccgggatactctagtaacg

SEQ ID NO: 281601 - DNA, 1484 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaa

SEQ ID NO: 281602 - DNA, 1025 bp, Homo sapiens
ggctaggacgaggccgggtggttgctgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaa

SEQ ID NO: 281603 - DNA, 1724 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaatacttgccgtgtagtttgtttgttgacctcgtatgttagaaaattttacaatgccagctacatctgttgattttaaatgtcagagaagttgtaccctgtttcaaaagtatactaagtgatactacttgtaatagaataaatcatcttggaattgaattgttaccttttgaagtaaatactggcaagtgcacaagccacataaacctgaataaaacttttgacctagggttgaaaaaaaaa

SEQ ID NO: 281604 - DNA, 1617 bp, Homo sapiens
  misc_feature (2)..(2): n is a, c, g, or t
ancattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggccttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggttcgttatcatggaaataaggttacggaaaaaaaaaaggggggggctaaagatcccgggcagtaggaccggtttgaagggcctaggggtaaaaggggggggtaaacgcgaggaagctgtttgggccctggggatgggccaaagggggaaaggtgggaggggggtaataaaaga

SEQ ID NO: 281605 - DNA, 942 bp, Homo sapiens
aggctggtaccggcccgacgtatgggatcccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggtattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaa

SEQ ID NO: 281606 - DNA, 1959 bp, Homo sapiens
gcccgccagtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcgcacagtggtggccaccgcgactggtgctgaagtgtcggcgcgtgccgggcgctccgctgggacccgggttgctcgccctgagtctcagctttctcatctgtacggttgggacaagtacagtaaccctcgcccgtcaagacgggccagggctgtggcgagggtccacgccttagagcaggcacctatcttgtgcagggccctgagacggggtctgactcagttcctgcggggaacttcaccagtgacccagtcagtgcccttcagttaaagaccaccaggagcacacttatatcatggaaatcaggacagtagcagttgggattgtggcaatcaaaggggtggaaagtgaattctatcttgcaacgaacgaggaaggaaaactctatgcaaagaaggaatacaatgaagattgtaacttcaaagatctaattctggaaaaccattacaacacatatgcagcagctaaatggacaaacaacggaggggaaatgtttgtggccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttttagtaatcaagaaaggctggaaaactactgaaaaactgatcaagcttgacttgtgcatttatgtttgttttaagacactgcattaaagaaagatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtgtatcagacctacaggctgctgcaggatttgtcagataatcaagccacactaactatagaaaatgagcagcattttaaatgctttctagtgaaaaattataatctacttaaactctaatcagaaaaaaagaatattctcaaaaaaatctattacgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacaaaataacattttataatttctcaaagtaaaattgagaaatctttaagtttttttcaagtaacataatctatctttgtataattcgtatttgggaatatggcttttaataatgttcttcccacaaataatcatgcttttttcctatggttacagcattaaactatattttaagttgtttttgaactttattattttgttatttaagtttattttatttattaaaaaaaccttaataagctgaatctgttt

SEQ ID NO: 281607 - DNA, 2167 bp, Homo sapiens
gcccgccagtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcgcacagtggtggccaccgcgactggtgctgaagtgtcggcgcgtgccgggcgctccgctgggacccgggttgctcgccctgagtctcagctttctcatctgtacggttgggacaagtacagtaaccctcgcccgtcaagacgggccagggctgtggcgagggtccacgccttagagcaggcacctatcttgtgcagggccctgagacggggtctgactcagttcctgcggggaacttcaccagtgacccagtcagtgcccttcagttaaagaccaccaggagcacacttcattgctgttggaaaggctgatgccaatcaaaaccaatttttccctaaaggatgatctgtcttctcatcattttgacaggatgtaacaaaacaaaggagtcttcaatgttgctggagtgcagtggcatgaccatggctcactacagtcttgaactttcatgctcaagctatcctctgaccttagcctcctgagtagctggaactacagatatcatggaaatcaggacagtagcagttgggattgtggcaatcaaaggggtggaaagtgaattctatcttgcaacgaacgaggaaggaaaactctatgcaaagaaggaatacaatgaagattgtaacttcaaagatctaattctggaaaaccattacaacacatatgcagcagctaaatggacaaacaacggaggggaaatgtttgtggccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttttagtaatcaagaaaggctggaaaactactgaaaaactgatcaagcttgacttgtgcatttatgtttgttttaagacactgcattaaagaaagatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtgtatcagacctacaggctgctgcaggatttgtcagataatcaagccacactaactatagaaaatgagcagcattttaaatgctttctagtgaaaaattataatctacttaaactctaatcagaaaaaaagaatattctcaaaaaaatctattacgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacaaaataacattttataatttctcaaagtaaaattgagaaatctttaagtttttttcaagtaacataatctatctttgtataattcgtatttgggaatatggcttttaataatgttcttcccacaaataatcatgcttttttcctatggttacagcattaaactatattttaagttgtttttgaactttattattttgttatttaagtttattttatttattaaaaaaaccttaataagctgaatctgttt

SEQ ID NO: 281608 - DNA, 1906 bp, Homo sapiens
gcccgccagtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcgcacagtggtggccaccgcgactggtgctgaagtgtcggcgcgtgccgggcgctccgctgggacccgggttgctcgccctgagtctcagctttctcatctgtacggttgggacaagtacagtaaccctcgcccgtcaagacgggccagggctgtggcgagggtccacgccttagagcaggcacctatcttgtgcagggccctgagacggggtctgactcagttcctgcggggaacttcaccagtgacccagtcagtgcccttcagttaaagaccaccaggagcacacttatatcatggaaatcaggacagtagcagttgggattgtggcaatcaaaggggtggaaagtgaattctatcttgcaacgaacgaggaaggaaaactctatgcaaagaaggaatacaatgaagattgtaacttcaaagatctaattctggaaaaccattacaacacatatgcagcagctaaatggacaaacaacggaggggaaatgtttgtggccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttttagtaatcaagaaaggctggaaaactactgaaaaactgatcaagcttgacttgtgcatttatgtttgttttaagacactgcattaaagaaagatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtgtatcagacctacaggctgctgcaggatttgtcagataatcaagccacactaactatagaaaatgagcagcattttaaatgctttctagtgaaaaattataatctacttaaactctaatcagaaaaaaagaatattctcaaaaaaatctattacgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacataatttctcaaagtaaaattgagaaatctttaagtttttttcaagtaacataatctatctttgtataattcgtatttgggaatatggcttttaataatgttcttcccacaaataatcatgcttttttcctatggttacagcattaaactatattttaagttgtttttgaactttattattttgttatttaagtttattttatttattaaaaaaaccttaataagctgaatctgttt

SEQ ID NO: 281609 - DNA, 1990 bp, Homo sapiens
gcccgccagtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcgcacagtggtggccaccgcgactggtgctgaagtgtcggcgcgtgccgggcgctccgctgggacccgggttgctcgccctgagtctcagctttctcatctgtacggttgggacaagtacagtaaccctcgcccgtcaagacgggccagggctgtggcgagggtccacgccttagagcaggcacctatcttgtgcagggccctgagacggggtctgactcagttcctgcggggaacttcaccagtgacccagtcagtgcccttcagttaaagaccaccaggagcacacttgatgtaacaaaacaaaggagtcttcaatgttatatcatggaaatcaggacagtagcagttgggattgtggcaatcaaaggggtggaaagtgaattctatcttgcaacgaacgaggaaggaaaactctatgcaaagaaggaatacaatgaagattgtaacttcaaagatctaattctggaaaaccattacaacacatatgcagcagctaaatggacaaacaacggaggggaaatgtttgtggccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttttagtaatcaagaaaggctggaaaactactgaaaaactgatcaagcttgacttgtgcatttatgtttgttttaagacactgcattaaagaaagatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtgtatcagacctacaggctgctgcaggatttgtcagataatcaagccacactaactatagaaaatgagcagcattttaaatgctttctagtgaaaaattataatctacttaaactctaatcagaaaaaaagaatattctcaaaaaaatctattacgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacaaaataacattttataatttctcaaagtaaaattgagaaatctttaagtttttttcaagtaacataatctatctttgtataattcgtatttgggaatatggcttttaataatgttcttcccacaaataatcatgcttttttcctatggttacagcattaaactatattttaagttgtttttgaactttattattttgttatttaagtttattttatttattaaaaaaaccttaataagctgaatctgttt

SEQ ID NO: 281610 - DNA, 1139 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggtttggatacatccctatcctttttagcaatcagtttgaaaatctgtagaaacttagacaaaattagtagaaagtaattttaaaaattgtgtttattaaattagtttctacttgatcatttgttattgccactagatgtgatgtctgatattttctgaattatactaaattagtttctact

SEQ ID NO: 281611 - DNA, 809 bp, Homo sapiens
  misc_feature (56)..(56): n is a, c, g, or t
  misc_feature (719)..(719): n is a, c, g, or t
  misc_feature (752)..(752): n is a, c, g, or t
  misc_feature (759)..(760): n is a, c, g, or t
  misc_feature (772)..(772): n is a, c, g, or t
  misc_feature (777)..(777): n is a, c, g, or t
aagcattggtatcaacgcagagtggctcattactggctcgggtgcggagtcgcttnatcagctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaagagggacgantactttgccaaaaaattgaggaagaaccaatangtgggcnnattagagcaacngggcngagcaaccagttgagaagactagtgtttcaag

SEQ ID NO: 281612 - DNA, 1221 bp, Homo sapiens
cagcacctctggaatccccttaaagcttgacagggatagaagagctgacacccggtctgggctgggcatctcttggggcagagagtagggttgatggtcagggctggggacgtgtctgggtttgagtctccatggggggtggcaggaggaggactatcttgtcccctcccatccttatgttctggaatggagaggcgatgccaaggtggaagcctgcattggctggggagctgagaaacatggaacattccattgaacagaacccccagcctacgcattctggttcatggagatttgcccaggagagacaggaagttcccataaggttagggaggaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaaaatggactcggttggcctacacggtggagctgtgaggacccttaccttttgtggggggtttatggtggatcctgggtgcctagcttccttatttgtacgccacgtcttccgggtccccgtcactttcctgtcagcgacgtaccagctttcaccgca

SEQ ID NO: 281613 - DNA, 484 bp, Homo sapiens
gaactctgaaggtagaaataaatgaatgtggactatgatggatttttaaacatccaatttccacataagaatgtattcggtgtatacttgacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281614 - DNA, 843 bp, Homo sapiens
ttctgcttttactccatttccaatctattaccaatcatgcacattttgccacactgtaaagcatagtttatcttctcagcacctgcatgaaaattttggttgggcgaatacatgttggcccttttggatattaggattgagatttgtcttacctgctataatatctatcttgattttccattctgcagctttcttttgaacatggctgaacataaataatatgttgttatgagctgatttttaaataatgattttttaaaattgctttttactaatacttgagattgagtttttaagcttaaaatttcattagaatctagacccttataaaaatttcaattgaatggatagtattctgaaaataataaatcaatttcaatacatttaacaatctgaaccaaatcacacaataaatccaagtgatagaaagctactcatgcaccacataatgccatttggggttatctagggactgcatatattttggtagtcccataaaattataaatggagctgaaaaattgctattgcctaatgatgtagctatcttgacatcacagcacaacacattaccttcttggtgtttatatatgttttggtaccagtaccatgctattttggttactgtagctttgtagtatagtttgaagtcaggtagcatggtgcttccagctttgttctttttgcttaggattgtcttggctatgtgggctcttttggttccatatgaaatttaaagtagttttttccaattctgtgaagaaagtcagtggtcgcttgatggtgatagcattgaatctataaattaccttgggtaggtatggcctccatgactttttcaaaa

SEQ ID NO: 281615 - DNA, 1681 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281616 - DNA, 1688 bp, Homo sapiens
  misc_feature (56)..(56): n is a, c, g, or t
aagcattggtatcaacgcagagtggctcattactggctcgggtgcggagtcgcttnatcagctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281617 - DNA, 1842 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaaaatggactcggttggcctacacggtggagctgtgaggacccttaccttttgtggggggtttatggtggatcctgggtgcctagcttccttatttgtacgccacgtcttccgggtccccgtcactttcctgtcagcgacgtaccagctttcaccgca

SEQ ID NO: 281618 - DNA, 1586 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtcctttgatttctttttgtgaagcttgtatgatgcaggcaggtcatagttaagtttaaactctttctcttttgtctttcttcatttaatcgtgtggatggaagtgtgtagacct

SEQ ID NO: 281619 - DNA, 1287 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtggggcagaaacaaatgacaatggtggaatgtcttcagttaaggctgttttcacttctgtggatcttcagttgcttcaggccatctggatat

SEQ ID NO: 281620 - DNA, 1584 bp, Homo sapiens
atccttaattaaattttttcccccccccgaggctggccggcggcgctgggaggtggagtcgttgctgttgctgtttgtgagcctgtggcgcggcttctgtgggccggaaccttaaagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281621 - DNA, 1506 bp, Homo sapiens
  misc_feature (34)..(34): n is a, c, g, or t
cgatctagaggatcccgtcaatttctacactcanaatagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281622 - DNA, 1512 bp, Homo sapiens
  misc_feature (104)..(104): n is a, c, g, or t
ggtggctccctcgaaatcatttgtttacagtctggccaaggttgtggcctccagtattccccctaagagatgggatctttgcctaaaagttactgagaaacganggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281623 - DNA, 1577 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281624 - DNA, 1759 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaaggtatgataatacagactttttctagttttaaaatatatgggacataacttaaaaaaatattttccttcctttttacagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281625 - DNA, 2066 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaaggtatgataatacagactttttctagttttaaaatatatgggacataacttaaaaaaatattttccttcctttttacagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacagtaagtatgttgaactaatcacgacataatttgaattccttaaaactctgacagaaatatagctggtgagctctgaaatagtggcagtagacctttctctttgctagtgaaacactgagatcttaagctgccttgacaatctcagggccaaattgcattgcagtctagcattggacgatcaaaaaaaacctaaggacttctggctttggttaagtaagtttagtgatcatgattggttaactttattaggacttaattttcttatatagtaaatagaagtatgttataattatatttttatttgtagggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281626 - DNA, 1018 bp, Homo sapiens
cgctgcggcgctctgaggatcccttattcgtgttgcacgggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281627 - DNA, 1014 bp, Homo sapiens
ccccaataaaataaaaaagtcttaaggcgaagattggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281628 - DNA, 2260 bp, Homo sapiens
  misc_feature (1407)..(1407): n is a, c, g, or t
cggtgaagactgacaagaaggggatgtctatggtcgtacaggatggggggtggatgagcgctagggggatgtgggagagagtggcggtgggggaggaagtgtgagaaaagtggtggcgtgcatttgggtggagttgaaggcgcgtcgtgtgtttggggggtatgggagtgttagagaggttggtgatagtggtagtagagagggtttggcagaagtggcaggggggcgtttgttggtaggagtgctccgcgtggtgtcgcctgtaagatggccgtgatatgacaagtggtagggcggtggtgtggagaaaaggtgggggattagaagggtgctgcggtgtgggcggaagaagcgcgcacaagcttgtctgcgaaggagccctagaagaagcttgcggcatgaaggggggtccaatgggaagaagtgctgtgcgcacgttggtgggaagacaaacttgcccatggggttgggatgaacgggaaagttgagtcgtgaaatcgcgtttacgagagaacgttcccgagagaaataaggggggtttccgttgcgcaagaaggggccgataatatcctccgccggcgttaagcccgccgttggaagagcgctggggaagcctgtgggaagttggcaagggttatggtaggggagagaagttgagaaggtgggttagtggaggtagtggaggccaagggagtgcgcgtgggtggtgttagataaggtggtaggagaatggggcctttgtggcgccgcagaggcgtgggaaggtgggcgagagcgtggcgtgtggaggtgggatgctatgtaggatgagagggagaggtgggggttgttaggagagggaactagagagggggttggcaagagggtgagccgttagagaaggtaggtgtgcgaggaggtcgagggaagagggatgaggcaagtgttggcgaggttagagatggcgaggtgtgtaagagggggggaggtgcagaggtgtgtgtgtagtttggtcgggtgtgtggaggtagggcaggtgtggaaggtgcttggtcgtgagaggagagaggtgtgtcgtagggagggagccgccgcgtgggacgcagggagaggggtagccagagagggagagagcgaggagcgcgtgggcgtagagtaggcgtggtgtgtggcagaggggagctggagtgtaggcgtgttgggcgcagtagagaagtgagaaggttgatagttagagagggagagagagtctatatagagtgagatagagtcggtagggcgtagagaggttgagaggagggcgtagagagcaggggagggtcagagggagaggccagagagagcagagagaggtgtagagaggagaggagtggcgtgaagagtgagaagtgctgctaggagatgagaggaggagttggatggctgtgnctgagaatttgtgcgggtgagtgttaggagtgagtcaggagcgctgtaggaggaaggagtttacagcagtagcgttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281629 - DNA, 1080 bp, Homo sapiens
aggtatgtatgactatgcgtatatggcagctgggcgcaccgaataagcgataacagttagaaaagctagtgagatgcattaggacttgatgtacgcctagagcaggagtacctgaggtacatcgaacatacgatagactgtgagagataccgtacagacctaggctgaaaatgacagcctcctgcgtaggaaaagaccagagacttgttggcttggactcagcttgccatattgcaggtgtcgtagatgagtgaattgaatctgaactctgattcaagcaggatttccacagtagactttcctcatctcattggtgaccctgaacctgggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281630 - DNA, 1060 bp, Homo sapiens
cagcacctctggaatccccttaaagcttgacagggatagaagagctgacacccggtctgggctgggcatctcttggggcagagagtagggttgatggtcagggctggggacgtgtctgggtttgagtctccatggggggtggcaggaggaggactatcttgtcccctcccatccttatgttctggaatggagaggcgatgccaaggtggaagcctgcattggctggggagctgagaaacatggaacattccattgaacagaacccccagcctacgcattctggttcatggagatttgcccaggagagacaggaagttcccataaggttagggaggaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281631 - DNA, 702 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattgtaagtgggcctgtaatgcatttaaatatcttacatttatttagaaagtaaagtacggaagaataagggctcaggaatcacagcctcactaattactgtatgtcctttcgtaatattcttaacctaagtttcttttgttttgttttgttttgagacagtctcatcctgcactccagcctgggagacagagcgagactccgtctcaaaaa

SEQ ID NO: 281632 - DNA, 462 bp, Homo sapiens
cagtgataaaaatggtttttatttttgtttaattttttctagacagggtcttgctgttaccaaggctggagtgcagtggcacattcatggctcatcgcagccccgaatacctgagctcaggtgatcctcccacctcaaccttctgagtagctaggactataggtgcaccaccacacttgggaaattaaaatttgtgtgtgtgtgtgtgtgtgtgtgggtagaggcagggtctaactatgttgcccgggatggctaccaattcctggccccaaatgatcctcctgtatcagcctcgcaaagcactggcattacacgcctgagccactgcgcctggccttaaaaatggttttaaaatcttttctataaatataccaatatacccgattcttgttacaaacctttattatttttggtcccaaagggaggattcataattactgtatcgaatgacttggacattct

SEQ ID NO: 281633 - DNA, 555 bp, Homo sapiens
gtcatttattctgatttttctttaacagtttggttgttgaacccatttacttgagcaaaaactttaatcagtgttcaaaaacattgacaagagacttaaaaaaagttctttacagagtgctcaattgtgtctctacaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggtaagttttttttaagtcctttggtagtttcatgagaaaatttctacttccataaataaatgatttgccagagagaatagggatttggcttttcaactcctggataagtgccattcttggattattaacgatttacctcggttatgctgttgtataagtcagggacaggatatttggaagatgaatctagaggtcaggtctgtactaagagaaaagccttttctcattggtgcaaggaagttgttgcatctttttcaacagtatcattattagtaa

SEQ ID NO: 281634 - DNA, 1759 bp, Homo sapiens
tacctccaccgccttctagtctcaccgaaggcttgtggccatctctgtaaagtttctggggaggtgggcacggggtaaacgccggagggttctgtggagcctatgggactgactggaggccaaagaactttgggccgcagatgtacaccagcgtcactcttttggtctgttagggccttcatcgctcacatcaggtttcagtgtgaaacgggaaaacatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281635 - DNA, 887 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgatacttggcaaaaaatgagaagaaacaataagggagtaattagagtaacgggcaaaaaaaaaaaaaaaaaatttgggggggccgaaattttaaacttgtggggggccggtagaatgtaggtcggacgcggaggggttccaaaacgggggggtgcaaagttgttgttcaggatttactggc

SEQ ID NO: 281636 - DNA, 1659 bp, Homo sapiens
atccttaattaaattttttcccccccccgaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281637 - DNA, 2603 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaacagtttttgattttttttttctttttgtacccaaagcatttaggaaagaactagaatattagctattgacgatgggcctttcccacaggccatttatggtgtctcctaggctggctttgtatatttacacaggaaagttggtaacactagaaataattacttgtcacaaagctttcctttttttttctttttcgagactgagtctcactcttatcgcgcaggctggagttcagtggggcaatctcagctcactgcaacctctgcctcctgagttcaagcgattctcttgcctcagcctcccgagtagctgggattacaggcatgaaccaccacatccggcccagaaagcttttcaataccgaatgtagaccagccaaaatcaagagacttactgatttctttttgtgaaacttgtatgatgctggcaggtcatatcgaagttctgctataatatctatcttgattttccattctgcagctttcttttgaacatggttctctagttgaggatttgtgtaaggaatatactgctgttcttgccatttccaaagcagtctttagaaaagccatatctgtccctttattatttttggtcccaaagggaggattcataattactgtatcgaatgacttggacattctgttagataataagcacacatcacattgaaccatgtcaatatttgttaactcaaactcttctgcattcctattaaatatttccaatgcgtcttcatctatgtcaaatccaacacacaacctgcaatgtgcggcctggtaggatactgttccagaagtagctgggcttttcaaatcccatccacttgctgcaggcgactctctagatgcgttaagccttactttcttcattttgttttaaagtatggactcgtagggtttgaaggcacaggatctgc

SEQ ID NO: 281638 - DNA, 2158 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaataaataaaagaaaaagtaaatggtaggagaaaagaaaaagaaagcaaagaagagataaaaaaataatagaaacaagaaggtaatagacataaccaatgaaaattaggaaaagaaaggggggggggcgtgttttttatattttttacccaaggggtaaggaagacaaatagtactaacaagatacattgatttagtaagaagaaggggcgcatcataaaatagggggtgaatatatataatacaatcgaggcgtaggcgcgcgttataataagataggaggagaaagaaaaatcaatgatcgtggtaatgtataagtgaggagcagaacatatttggggggggggaaagaaataagagaaaaacacaagaaagagtatacccagcaggagaacaacaaaattatgtagatgtgtaggtaacacatatttatgtgtgaggaagtgtttcagtagttataaattaggagggacaa

SEQ ID NO: 281639 - DNA, 1988 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacagtaagtatgttgaactaatcacgacataatttgaattccttaaaactctgacagaaatatagctggtgagctctgaaatagtggcagtagacctttctctttgctagtgaaacactgagatcttaagctgccttgacaatctcagggccaaattgcattgcagtctagcattggacgatcaaaaaaaacctaaggacttctggctttggttaagtaagtttagtgatcatgattggttaactttattaggacttaattttcttatatagtaaatagaagtatgttataattatatttttatttgtagggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281640 - DNA, 1747 bp, Homo sapiens
agaacgtttatcagaaaagcatatttgtaatcaccactaaacaatgaggcgcatcggtcccctctccccaaccaccctcactcttcctaaacccactctctcttttggcttttatagaacactgtagaaatcctttcctgagtctgcaaatggccccagactgggatgggagctgcccagagtagtcttgggctggactgagtcctggtgcccagagagggagacctatgcaactgcctccagtatccaaaagttccgttgaagccgtccggaactttaatattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281641 - DNA, 1696 bp, Homo sapiens
tagactgtcgtgggggcgcgaggctgagattcgtagctgatcgatgttcgtagacgtctgtgcgtagcgagaatccttgtgtgcgactcgaatacctgtattggatagctcgcccatgtgctgaaacagtcggcggattagatgaccagagatgtgtctggacactgagatcggcacaatgagtcgtgtctagtcgagtctatgtaagctagtgaatctaggcgacagcacgtgtcgatctctatagccaacggtcacataagtctatctttaaaggcacccgggactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281642 - DNA, 1369 bp, Homo sapiens
tagaggatcccgagggcttcaacggaactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281643 - DNA, 832 bp, Homo sapiens
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttccgttgaagccgtcgggtcctctagagtcagact

SEQ ID NO: 281644 - DNA, 1262 bp, Homo sapiens
cacgattctttgccaaattaaatgaagaaagaaaactaaataaagtggaagctaaattaagagctaaacaggagaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaa

SEQ ID NO: 281645 - DNA, 802 bp, Homo sapiens
  misc_feature (712)..(712): n is a, c, g, or t
  misc_feature (745)..(745): n is a, c, g, or t
  misc_feature (752)..(753): n is a, c, g, or t
  misc_feature (765)..(765): n is a, c, g, or t
  misc_feature (770)..(770): n is a, c, g, or t
acccaggcggcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaagagggacgantactttgccaaaaaattgaggaagaaccaatangtgggcnnattagagcaacngggcngagcaaccagttgagaagactagtgtttcaag

SEQ ID NO: 281646 - DNA, 757 bp, Homo sapiens
atccttaattaaattttttcccccccccgaggctggccggcggcgctgggaggtggagtcgttgctgttgctgtttgtgagcctgtggcgcggcttctgtgggccggaaccttaaagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaagttagaagaagatctgaatgaaattcttggaagaaagattggggtgctgaaattcggggg

SEQ ID NO: 281647 - DNA, 127 bp, Homo sapiens
tgaggtagctgatggagaaagggcaaagtaagagggtggagaagagcaattaagaatggacagtttgttgttaaaaacaaaacactggccaggcatggtggctcacacctgtaatcccagcactctg

SEQ ID NO: 281648 - DNA, 3002 bp, Homo sapiens
  misc_feature (173)..(173): n is a, c, g, or t
gggcggacctaaaggggctcgggccgctcgggccgggaatggcggcggcggccgagcccggggcccgcgcctggctgggcggcggctccccgcgccccggcagcccggcctgcagccccgtgctgggctcaggaggccgcgcgcgcccggggccggggccggggccgggacgngaccgagcgggcggcgtcagagcccgggcccgtgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgcggggtccaggcgcactccctctgctccgcggcactggctcccgagtgtggcttcgggcgtctgcgctccctggtcctgcctcccgcgtgcgtgcgccttctgcccggcggcttcagcaagacgcagagcttccgcatcgtggaggccgcggagccgggcgaggggggcgacggcgccgacgggagcgctgccgtgggtccaggcagagagacacaggcaactccggagtccgggaagcaaacgctgaagatctttgatggcgacgacgcggtgagaagaagccagttccgcctcgtcacggtgtcccgcctggccggtgccgaggaggtgctggaggccgcactgcgggcccaccacatccccgaggaccctggccacctggagctgtgccggctgcccccttcctctcaggcctgtgacgcctgggctgggggcaaggctgggagtgctgtgatctcggaggagggcagaagccccgggtccggcgaggccacgccagaggcctgggtcatccgggctctgccgcgggcccaggaggtcctgaagatctaccctggctggctcaaggtgggcgtggcctacgtgtccgtgcgagtgacccctaagagcacggctcgctctgtggtgctggaggtcctgccgctgctcggccgccaggccgagagtcccgagagcttccagctggtggaggtggcgatgggctgcaggcacgtccagcggacgatgctgatggacgaacagcccctgctggaccggctacaggacatccggcagatgtctgtgcggcaggtgagccagacgcggttctacgtggcagagagcagggatgtagccccgcacgtctccctgtttgttggcggcctgcctcccggcctgtctcccgaggagtacagcagcctgctgcatgaggccggggctaccaaagccaccgtggtgtccgtgagtcacatctactcctcccaaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgcgtgcgcctgcccctgagagcgatcctaggtaggggtggctggggcagcccaagggctcgagccatctctgctcccgccagccttgttttcaggtggtctggaggcagctccacgtccacacagtggctgtcatatattgaagttaccttcccactggaaaaaaaat

SEQ ID NO: 281649 - DNA, 3303 bp, Homo sapiens
tcctggggaggctgcctttggggtgagatgtcacccctggacaggcggaggggctgtccctggccccagtgctgtgtgtccttcgcctcccaccgccctgaccacagcctgcctttgcagccaccgtggtgtccgtgagtcacatctactcctcccaaggtgagctgccctgagggacgtggtcacatgaggcccaggggtgttcctggggtgaagtgggacagccctggccctcacgtagcacctgacctttcccttgggcagccctgggctggggaaacgtcctggtttggttcctgccctggcaccgtgggggccatgggacaggctccccctgagtcctgggctcctgccgcaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgcgtgcgcctgcccctgagagcgatcctaggtaggggtggctggggcagcccaagggctcgagccatctctgctcccgccagccttgttttcaggtggtctggaggcagctccacgtccacacagtggccggccctgtggtcggacctggctacagccctgaccacagcatcttcccagtgacggagcgggacccgccctcatcccattggtgacacatgttggtgtcacagccctcatcccactggagactggtgtgcgggtggcagtgttaccccgtgtcccgggtgggcgcagggctctggatggtgagccctctgccctgtgggggcctggtcctctcctcaggggtgggcacccatccctctccccactgagccccttgagctggacagtgctggatgcaggccgtccaggtgggtctgatctcactttgtgcccctcgggccgtccccctggccagtccttcagagcagcaggctccctggtgtgtccctgccccagcagacacaggctgccagtccctccagcctcacctccccgccctgggcagcaggtgtgggcagcgtgtgaggctgccgggtggtggtgactggtgacttccttgtgttcagggaagggagaaggtgccttcccttgttttctggccttgttatatacagatggcagcttggatctcaggtacagctccaggggcaggcagtgcccagctggacctggtggccctttcctagtgcctctgcttggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcagccctcctgctcccacgcccccagacagcttggtggagggtcctgcatctgggccaggctggggtgcacccagccaaagacaaagctgcctccacgtgcccaaggattcagatggtgcactggccccgggaggagtctgaccaaaaatggagcccgctctgtgggaagccccgactcccccacgagaaacggtcccacggtgcggatctcccccttcccttgtggggcacagctggcctgggcctccaatcctgcggagctttcctgggtgtggctttgacctcagaagtggctctggtttggcctcaggagtgtggcctggcccagcctgctgcagcctcctggggggcccttgatgccactaatcccccgaccccccgcatctgccaaactgcacagacacacgcattgtaaggccgcttgtggcctccagcgtgcactcttgtttacgtcattgtcatcttcaagaccagtcctttgtgattagttttgcttcgcgagccctggtgtggactgtggtctgtatgaatcgtgtgtaactgtggtgaggggcttgtcctgtatgtgagtctgtacccaggtggggtctgtgccctgcacaccgggcccctctgtatttatcgctgcctgaatgcaacagtaatttatatccaggacaaatacagtctgggcgtcactatccta

SEQ ID NO: 281650 - DNA, 887 bp, Homo sapiens
  misc_feature (173)..(173): n is a, c, g, or t
gggcggacctaaaggggctcgggccgctcgggccgggaatggcggcggcggccgagcccggggcccgcgcctggctgggcggcggctccccgcgccccggcagcccggcctgcagccccgtgctgggctcaggaggccgcgcgcgcccggggccggggccggggccgggacgngaccgagcgggcggcgtcagagcccgggcccgtgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 281651 - DNA, 4680 bp, Homo sapiens
  misc_feature (173)..(173): n is a, c, g, or t
gggcggacctaaaggggctcgggccgctcgggccgggaatggcggcggcggccgagcccggggcccgcgcctggctgggcggcggctccccgcgccccggcagcccggcctgcagccccgtgctgggctcaggaggccgcgcgcgcccggggccggggccggggccgggacgngaccgagcgggcggcgtcagagcccgggcccgtgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgcggggtccaggcgcactccctctgctccgcggcactggctcccgagtgtggcttcgggcgtctgcgctccctggtcctgcctcccgcgtgcgtgcgccttctgcccggcggcttcagcaagacgcagagcttccgcatcgtggaggccgcggagccgggcgaggggggcgacggcgccgacgggagcgctgccgtgggtccaggcagagagacacaggcaactccggagtccgggaagcaaacgctgaagatctttgatggcgacgacgcggtgagaagaagccagttccgcctcgtcacggtgtcccgcctggccggtgccgaggaggtgctggaggccgcactgcgggcccaccacatccccgaggaccctggccacctggagctgtgccggctgcccccttcctctcaggcctgtgacgcctgggctgggggcaaggctgggagtgctgtgatctcggaggagggcagaagccccgggtccggcgaggccacgccagaggcctgggtcatccgggctctgccgcgggcccaggaggtcctgaagatctaccctggctggctcaaggtgggcgtggcctacgtgtccgtgcgagtgacccctaagagcacggctcgctctgtggtgctggaggtcctgccgctgctcggccgccaggccgagagtcccgagagcttccagctggtggaggtggcgatgggctgcaggcacgtccagcggacgatgctgatggacgaacagcccctgctggaccggctacaggacatccggcagggaggcctcgagctgcagatctccccgaggtcctcgaggggaacggacaggggttgtccacagcaaggaagcctctgtggcccctttcctcgttttcctgttgacttaattcctgggagtgttcctgatgccctgttttgctgttttgcgggtgaggagacagagggcctggtgcggtggtgccgttctccccggcccagcatccccgcccctctccctgcagatgtctgccaccgtggtgtccgtgagtcacatctactcctcccaaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgcgtgcgcctgcccctgagagcgatcctaggtaggggtggctggggcagcccaagggctcgagccatctctgctcccgccagccttgttttcaggtggtctggaggcagctccacgtccacacagtggccggccctgtggtcggacctggctacagccctgaccacagcatcttcccagtgacggagcgggacccgccctcatcccattggtgacacatgttggtgtcacagccctcatcccactggagactggtgtgcgggtggcagtgttaccccgtgtcccgggtgggcgcagggctctggatggtgagccctctgccctgtgggggcctggtcctctcctcaggggtgggcacccatccctctccccactgagccccttgagctggacagtgctggatgcaggccgtccaggtgggtctgatctcactttgtgcccctcgggccgtccccctggccagtccttcagagcagcaggctccctggtgtgtccctgccccagcagacacaggctgccagtccctccagcctcacctccccgccctgggcagcaggtgtgggcagcgtgtgaggctgccgggtggtggtgactggtgacttccttgtgttcagggaagggagaaggtgccttcccttgttttctggccttgttatatacagatggcagcttggatctcaggtacagctccaggggcaggcagtgcccagctggacctggtggccctttcctagtgcctctgcttggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcagccctcctgctcccacgcccccagacagcttggtggagggtcctgcatctgggccaggctggggtgcacccagccaaagacaaagctgcctccacgtgcccaaggattcagatggtgcactggccccgggaggagtctgaccaaaaatggagcccgctctgtgggaagccccgactcccccacgagaaacggtcccacggtgcggatctcccccttcccttgtggggcacagctggcctgggcctccaatcctgcggagctttcctgggtgtggctttgacctcagaagtggctctggtttggcctcaggagtgtggcctggcccagcctgctgcagcctcctggggggcccttgatgccactaatcccccgaccccccgcatctgccaaactgcacagacacacgcattgtaaggccgcttgtggcctccagcgtgcactcttgtttacgtcattgtcatcttcaagaccagtcctttgtgattagttttgcttcgcgagccctggtgtggactgtggtctgtatgaatcgtgtgtaactgtggtgaggggcttgtcctgtatgtgagtctgtacccaggtggggtctgtgccctgcacaccgggcccctctgtatttatcgctgcctgaatgcaacagtaatttatatccaggacaaatacagtctgggcgtcactatccta

SEQ ID NO: 281652 - DNA, 297 bp, Homo sapiens
cgggccacaggtggcacagggagcagccagacaggtccctccccttccgtgaaatggggctgagatggcatcagctgcccggggccccaggaccgggggctgcccgtgtaccgttctttcatcggccatgtcaccctggtcctctgtcccctgccctgggacaggtgcacatgctgaggaaggccaagcagaagccgaggagggccgggaccaccagggatgcccgggcggatgcgtgcgcctgcccctgagagcgatcctaggtaggggtggctggggcagcccaagggctcgagc

SEQ ID NO: 281653 - DNA, 1063 bp, Homo sapiens
ttgttatggcaaaggtggatcccggtgctttgagattggacgactggggtgaggcgggcagctaatgcgcagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaacatggcggcccttgtaagcaatttacaagtaacccccgaagaaccggcttttactgtggacttccccacaaaaatggtcccagggtgcctgggtttagggacaagaaagacagggctcgtcaaggaagagacgggcgacaaagaagctctgcagaacgcgaaggggtgaatgcgcgccacgctttgcgaacacggtggccgcaacaagaggagggcggaacaccaaacccgagcgagagataa

SEQ ID NO: 281654 - DNA, 490 bp, Homo sapiens
tcatccctagtgtaaattgtgcttagaccaataacacatttaaaattatagagcttttcatcactacggagatgctcttgcctatgataggaacgatggctacatctgaagctgagcaaatttatcttttctcttcgtctgcatcagggtgacctctggaagagcaatttaggaccatcagtgttacagagactccaaccaacttgcacagagccctaagctgccgtgtaaggcatctgactacgctgaagccactacattggaaaggtcacatggaggagctccagctgacagtctcggaggagctcagcttcaagccatccctgcaaggtatcagccatataaatgaatcagcccagctgccagtcaagtatctttgcatggcttccatcagtgcctcatgaaacggaagattgactagccaagacttgcccaaattcctgacccacaaaatcatgagatataataaaatggttgttattttaagcca

SEQ ID NO: 281655 - DNA, 1876 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281656 - DNA, 1902 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgctaatagcccatccttctttgatccatcatgtttgtcttgcgacgaatccact

SEQ ID NO: 281657 - DNA, 1823 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281658 - DNA, 1116 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaacatggcggcccttgtaagcaatttacaagtaacccccgaagaaccggcttttactgtggacttccccacaaaaatggtcccagggtgcctgggtttagggacaagaaagacagggctcgtcaaggaagagacgggcgacaaagaagctctgcagaacgcgaaggggtgaatgcgcgccacgctttgcgaacacggtggccgcaacaagaggagggcggaacaccaaacccgagcgagagataa

SEQ ID NO: 281659 - DNA, 1792 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281660 - DNA, 1788 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaattacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281661 - DNA, 1917 bp, Homo sapiens
tcatccctagtgtaaattgtgcttagaccaataacacatttaaaattatagagcttttcatcactacggagatgctcttgcctatgataggaacgatggctacatctgaagctgagcaaatttatcttttctcttcgtctgcatcagggtgacctctggaaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281662 - DNA, 2001 bp, Homo sapiens
tcatccctagtgtaaattgtgcttagaccaataacacatttaaaattatagagcttttcatcactacggagatgctcttgcctatgataggaacgatggctacatctgaagctgagcaaatttatcttttctcttcgtctgcatcagggtgacctctggaaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281663 - DNA, 1834 bp, Homo sapiens
  misc_feature (1742)..(1742): n is a, c, g, or t
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatggaaagaaatccccaaaggacgccaaggattaacatcggggcttcaagcatggccttaagatagggggacgaagtgagaatgactcagncggctgagatctaaacgccaccgcaaccgtggctccccggtagcacacacagacaagcggcggacccaccacgacgcaccgctataaccacc

SEQ ID NO: 281664 - DNA, 1698 bp, Homo sapiens
gggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtagcgcattactaatggagggtttcttctttttttttgagatcccccttcttggtaacgcatttgattccgcccctagggaacgggcc

SEQ ID NO: 281665 - DNA, 1863 bp, Homo sapiens
tccggttaagaatgcaacactcaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 281666 - DNA, 3409 bp, Homo sapiens
cccgtttacagatttcattacagatggacactgtttcaaggtgcactggcatgcactgtctaaaacggtttcatgctgtaccccagaaggcattcagtttcacagtggagggctgtattgagttggtattctggatgatacaatttttagggctagaaagtttagagtgttggctggctcacaggctgcaaaggaaataatggtggagtccagaccacagcagtaatttcaattactaacacaaagaaacccattgtctgcaataatgaatataactgcagtgtcttgttttgttttaaattcttgtgtgcgatgaagggggcgaatctatcagacaacctatcaattgggctgatgatgtcagtgttccagtggcttctaacaggcgttaatacctgttggaaatggattatcattggctgggacgattgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281667 - DNA, 454 bp, Homo sapiens
gctcagaggtctctcttcctgttacgtgctctccccaagtcaggcctagaaagacccgtgggaccagggacacactccccagccctgtgttgaatgggaccagtgcccgaagggtgccccggagtatgcactggcaggtagcagggtcaccctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281668 - DNA, 1009 bp, Homo sapiens
  misc_feature (776)..(776): n is a, c, g, or t
  misc_feature (1009)..(1009): n is a, c, g, or t
ggattggcggttgcttggcgggcggtgtcaggctctcggtggcggcggaggcggcggaggccagggaggaagatgtcgtaatgagcgggggcgaatctatcagacaacctatcaattgggctgatgatgtcagtgttccagtggcttctaacaggcgttaatacctgttggaaatggattatcattggctgggacgattgatccacagaccagcatggctgccactgctgctgtgagtcccagtgactacctgcagcctgccgcctccaccacccaggactcccagccatgctccgcttaagccctaggcttgctggcaacagtagtaggcgagaatggataggccctaccatgcaggtagatatcgggctggtagaactgcgcaccgatcactccccacagtcccgacaccgacaggaagagtagatactccgaagacgaaatcgagccgccggcgacgcgcaacgcatgccgccgggcaataagaatcggaggatgaggacggatgaccacgcgaattaaaaatcaaacgacaacacgactatcgatatagacatcggacgagatccacctacctaataccgagaagaaaccttgattgtgattcggctaaaggcattaattcccgaccaagaaagacaagcgaatttagggccctattgcagaagaagccaataatccaattgtcgaaagcgggtcccaactatagaccagtatcaaacgggtggcccagaaagcaatggcccaggagatacagagcccaaatacgactgccnaaagccaagtaatacacaaaacgctatgcgcccgaaaccagacccaaatccagaagggcccaaacaaggcaccgccgtaaacaaccaaggacctaagaccacaaaaatcgcgagagaccccgaaaaccagaggcctaataccccccaaacccgagtaaaaaactaacaaaacttaacagaacaggctccccatggaacaagtatatcgagaagatcaaaaatagggagagacn

SEQ ID NO: 281669 - DNA, 3380 bp, Homo sapiens
gggggccggcgagaggagcgggcaccggggtggcctggcacccctcggacgggtgccgacccacttcaacgccgctctcccgcctgggcgaactatgcctgggtcggctctgaggaggcagccaacagcccttgtgttcgccccgtgtctgagaggccttcctgcactcttaactgtagatgcccaccagcgattcagggctccccggagaacagagaggggcgagggaacgcttgagacccggacgctgccaaccagatgggcactgctcggcatcgacgacagcccgggggcgaatctatcagacaacctatcaattgggctgatgatgtcagtgttccagtggcttctaacaggcgttaatacctgttggaaatggattatcattggctgggacgattgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281670 - DNA, 4021 bp, Homo sapiens
tgggattacaggtgcgcaccaccacacccagctaatttttgtagttttagtagagatggggtttccccatgttggccaggctggtctcgaattcctgagctcaagtgatctgcccgcctcggcctcccaaagtgctgggattataggtgtgatccaccgcgcccggccatgaataaaaatcttaaagatcatttggtccaacttcccaccccatctcaacatcctgactccagcagggacacatgtcctgcctctggttaagtgattccagagaagggagaacatagtacctcagaaggcaactgattttcatcttttcaaagttctctcttgtgttaactaaaatctgcctcaaaatgtccacacaggagtcttggttctaccctttgaacccatgtccccactctggcaccctgaccacaaccattgctgctgtcttctgaacaagctccagctgaaaatcccccttttaaaatgtccctcagaacagaacctgatgctccagatgtggcccaagtgtgtaaactacaggaggatattatttttttgttctatgactgaacttttagaaatgcaatccaaaattgcagtagcctttttggcagccatatctagattgtgctggcccccattcagcttaaagtcaaaacctctggggcttttccacatggcactattaggctctttctgccctatatgcatgtgattggttttttaacctaagtggaggacttatttttttaatatacagacaaggtttcaccatgttgcccaggctgggctcaaacacctgagctcaagtgatctgctcacattgcccttccaaagtgctgggattacaggcttgagccactgcacctggccaggacttattaaactttaaagccatatatgcctttaaaccctcgatgcagtgatataaattattagagcctcacagaaatcctagaaggatgacattacctttgttttacagagggcactaggaggaggctaagagggaccatcccactaatgaaccacacagtcagaatctcatttagatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281671 - DNA, 3170 bp, Homo sapiens
ggataagcggatagggtcagccagctgtggtccagcaggtcaggtggtgcccccaaggccgagcagcagcaggtggtacagatcccccagcaggctctgcgggtggtgcaggcggcatctgccaccctccccactgtaccccagaagcctcccagaactttcagatccaggcagctgagccgacacctactcatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281672 - DNA, 1230 bp, Homo sapiens
ggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgcttcctgccaaactgggatgctgaattcaacaagaatgttcttatttttggcatttattaatgtgctctaatactctggaatctctttggctctgtgaggcaagttttattctttgttcatgcctgctaagtgccagtaattgtgcccatgttgcagatggataacccagaactcagataatttatgaagtatccaagatcaaatagggcataaatgacaggaaccaggagtcaattgagatttgtaacttcagaccccacactcttccatcttccaccttgactcttgtgtcttatgtgtagcaggtgctaccattaaaattgaggagtttttttttttttaatataaaaaacagttcccactctcagtcattcggttcttcctctatagacaactaggtcatacattcctcgatggcaggaactgttttttatattaaaaaaaaaaaa

SEQ ID NO: 281673 - DNA, 1860 bp, Homo sapiens
ggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgcttcctgccaaactgggatgctgaattcaacaagaatgttcttatttttggcatttattaatgtgctctaatactctggaatctctttggctctgtgaggcaagttttattctttgttcatgcctgctaagtgccagtaattgtgcccatgttgcagatggataacccagaactcagataatttatgaagtatccaagatcaaatagggcataaatgacaggaaccaggagtcaattgagatttgtaacttcagaccccacactcttccatcttccaccttgactcttgtgtcttatgtgtagcaggtgctaccattaaaattgaggagtttttttttttttaatataaaaaacagttcctgccatcgaggaatgtatgacctagttgtctatagaggaagaaccgaatgactgagagtgggaagttgtgtaatttcctgggtggagaagagagcctttgaatttgaactgtggacatagaaatcacacaggaattcacccttctggcatatttaatgttgccaggtattttttataagtcatttatcacaatatctgtgaattcccatgatcagacctaccctacaggtgatattttatgttgccaggtgattttttataagtcatctatcacaaatatctgtgaattcccatgatcagacctaccttacaggtgaagaattgtggcacctgctcaggagcacatcctcggcattgcctcccctcccttccatgaggtcccatttcttgaggttgatggagacaggactaaaacccaggtcttccctaaggaaataatgatacatatgcagaaagatttagctacagtattattttttcatgactacacagctttataacatcccaacatgctgattattatacaactgataccttgttaactgtatatatctaggctgtttccaatcttacagctaaataaatccctgaaagtgggtcaaggacacgtacatttttaaaaaatttgtattctatattagaggtttgcagtctgtgaccaactttgaagccaaatctagcccacctgcctgtttttgtaaataaagtttaattggagtg

SEQ ID NO: 281674 - DNA, 363 bp, Homo sapiens
ggattggcggttgcttggcgggcggtgtcaggctctcggtggcggcggaggcggcggaggccagggaggaagatgtcgtaatgagcgagggcactaggaggaggctaagagggaccatcccactaatgaaccacacagtcagaatctcatttagatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcgatttctgaagaagggtcgtgaa

SEQ ID NO: 281675 - DNA, 3045 bp, Homo sapiens
  misc_feature (32)..(32): n is a, c, g, or t
  misc_feature (39)..(39): n is a, c, g, or t
agcagctggtcccggtcggagaagtatgaggnatcggangccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281676 - DNA, 3065 bp, Homo sapiens
ggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaatagcag

SEQ ID NO: 281677 - DNA, 1056 bp, Homo sapiens
  misc_feature (32)..(32): n is a, c, g, or t
  misc_feature (39)..(39): n is a, c, g, or t
agcagctggtcccggtcggagaagtatgaggnatcggangccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctcatgaacaatgagcaggtatttcctgcctggatgat

SEQ ID NO: 281678 - DNA, 414 bp, Homo sapiens
cggggcatggagttccactgcaggaatctccaggaaccctgaggtcctccctgagccagggccgggctgggcacaccctgagtgcccacagggcctaggggatgccaaattccagggtccagaaagagcttgggataaaatgaaacttcaaggggacggctttgacctgggctgagtctgtctgtgccatccaactggagtctcaagtcctgaggcaggacgtccagatgccccagtgcagggccctcctgatcaacacctgctcccctgtactcattagcaacctcacccaccctactctcaaagcacacttggctctcgtatccaggagctctgcatctatagattcggcaacagcagatggaaaatattcagaaaataaattggatggttatgtttctattgaacatgtgc

SEQ ID NO: 281679 - DNA, 462 bp, Homo sapiens
ccaggccggttactgcctctctgaccccagacgtctcatctgtcgaatggggacatttgggaacagcacccactctacgaagccaccatggagacgaaagagccaatcgtctacacgggcagtgtagaacgggcgcctgggcctaggggatgccaaattccagggtccagaaagagcttgggataaaatgaaacttcaaggggacggctttgacctgggctgagtctgtctgtgccatccaactggagtctcaagtcctgaggcaggacgtccagatgccccagtgcagggccctcctgatcaacacctgctcccctgtactcattagcaacctcacccaccctactctcaaagcacacttggctctcgtatccaggagctctgcatctatagattcggcaacagcagatggaaaatattcagaaaataaattggatggttatgtttctattgaacatgtgc

SEQ ID NO: 281680 - DNA, 480 bp, Homo sapiens
cctcagcttgcagacagcctattgtgggacctcgtgatcatgcatctgtgtgcaccaatgcagaaaagacggggactacaaggaaggaaaatgttgcatcaggaagggctgctggcacatctttgttccccctccccaaaacctcatccccaagcagggcctaggggatgccaaattccagggtccagaaagagcttgggataaaatgaaacttcaaggggacggctttgacctgggctgagtctgtctgtgccatccaactggagtctcaagtcctgaggcaggacgtccagatgccccagtgcagggccctcctgatcaacacctgctcccctgtactcattagcaacctcacccaccctactctcaaagcacacttggctctcgtatccaggagctctgcatctatagattcggcaacagcagatggaaaatattcagaaaataaattggatggttatgtttctattgaacatgtgc

SEQ ID NO: 281681 - DNA, 651 bp, Homo sapiens
ttctgaagttctggccctacatgaactatttcaagtctgaaattcccagggaaggcgggaggaaactcctgattggcccaggttggttcaggagcagactccctcctcgatcaactgtgatcatgcaggagcagcagagtctcagtgcataaaacagggagacttatttcctccacggctatttagtagacactggagccacagtccagtgagctaatttaagagagaaactcggagcacagaatgctcagttccacagaattccaacacacaagtctaacttattactgtatctcagttacctctaccattacctataaatggcataaagtaaaaattaagcatgtgaaacagttaacctcaattataaaaataaaatgcatttaaattatacacatggagtatacaatatatttacttattgcatacaaattctgctcaactagaaagttttgtgtacagtagaaacagtggtaagaatttctaataagtcccaattttatttctttgatcctaagcctctacttgtttccctcccacaattgggctgggtgttactaacccatgtgcacattaattacagcatttatttttccctaaaaagttgttattaagctaacagtatatcatctaaaaagtactgttaactta

SEQ ID NO: 281682 - DNA, 723 bp, Homo sapiens
gcttactagtgatcttgaacatgctatttaatctctagatacaaagtggtgatgacaatatcaataataactaccttgcagttccctgagagaatcagagataacatatccaaagtgtttagcaccatacttagcatacagtagcagagtaaaaactcagcaaatggaagctatgattttaaaagctaaacaaaactatacaatatcagctggtttttttttcccttagggagacttatttcctccacggctatttagtagacactggagccacagtccagtgagctaatttaagagagaaactcggagcacagaatgctcagttccacagaattccaacacacaagtctaacttattactgtatctcagttacctctaccattacctataaatggcataaagtaaaaattaagcatgtgaaacagttaacctcaattataaaaataaaatgcatttaaattatacacatggagtatacaatatatttacttattgcatacaaattctgctcaactagaaagttttgtgtacagtagaaacagtggtaagaatttctaataagtcccaattttatttctttgatcctaagcctctacttgtttccctcccacaattgggctgggtgttactaacccatgtgcacattaattacagcatttatttttccctaaaaagttgttattaagctaacagtatatcatctaaaaagtactgttaactta

SEQ ID NO: 281683 - DNA, 1423 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281684 - DNA, 439 bp, Homo sapiens
tgttggagatcatggagggaaggcaaatatccgataaagtagaagcaactgaggtaccgtgaaagagaaaggagctggaactgagaaaaagcagaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281685 - DNA, 1683 bp, Homo sapiens
  misc_feature (1469)..(1469): n is a, c, g, or t
  misc_feature (1588)..(1589): n is a, c, g, or t
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaaaaaaaaatctttttttgtacaagccttcaaacacacacgaacccanccgcctctcgggggggcccggttctcaatttgccctatagtggagggtttttccattaactggcccgcgtttaaaaaagtggtgaatgttaaaaccccggggatttcaaactcaattgnntttggggaaaatccccctttgccccagttgctgtacaccccaaaaagccacattcggaggggctttttaaaaactatttccgccgggaatttaa

SEQ ID NO: 281686 - DNA, 1330 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagctgtggttccgcgggcgggcagcctgggctgcgcggtctgagcgcttgttacaccccgcgcagggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281687 - DNA, 448 bp, Homo sapiens
  misc_feature (56)..(56): n is a, c, g, or t
aaggctctgatgcaaagcttggggggcatttcagaaactgaaaggccaacgtgggnagaacaaagaagagcctgaaagaagccaaatcttaccttctggaccatggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281688 - DNA, 1344 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacgagaacaggtaggaggaacctcgggactgaccgggacgccatggacacccagggccagacaaacaccaagcgacgatacaccaagacgggaaccccggtgtaaggcccgtgcaggcacccggcaccaacggtcccctgaggcggaagcaacgcgcccgcaccgc

SEQ ID NO: 281689 - DNA, 322 bp, Homo sapiens
  misc_feature (56)..(56): n is a, c, g, or t
aaggctctgatgcaaagcttggggggcatttcagaaactgaaaggccaacgtgggnagaacaaagaagagcctgaaagaagccaaatcttaccttctggaccatggtaagggtttctaagttcatcttaagagaagtaggttgcctttgaagacttttaacatgggaactttaaaagttccccgtggcggccgggcgcaatggctcacacctgtaatcccagcactctgggaggccgaggcgggcggatcacgaggtcaggagatcaagaccatcctggctaacacggtaaaaccccgtctctactaaaaataccaaaaaaa

SEQ ID NO: 281690 - DNA, 147 bp, Homo sapiens
aattcaagcttctaacgatgtacggggacatggtacccggacaccacatcgtttccattgaggtgcagagggagagtctgaccgggcctccgtatctctgaccacgatggcgcttacctttcagacttcattaaacttatgaccgaa

SEQ ID NO: 281691 - DNA, 541 bp, Homo sapiens
  misc_feature (7)..(8): n is a, c, g, or t
  misc_feature (28)..(28): n is a, c, g, or t
  misc_feature (30)..(30): n is a, c, g, or t
  misc_feature (33)..(33): n is a, c, g, or t
gcggccnnctactactactaaattcgcngncgntccgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281692 - DNA, 501 bp, Homo sapiens
  misc_feature (7)..(8): n is a, c, g, or t
  misc_feature (28)..(28): n is a, c, g, or t
  misc_feature (30)..(30): n is a, c, g, or t
  misc_feature (33)..(33): n is a, c, g, or t
gcggccnnctactactactaaattcgcngncgntcgtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281693 - DNA, 1455 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaaaagtcgacgcggccgcgaaattagtagtagta

SEQ ID NO: 281694 - DNA, 1432 bp, Homo sapiens
  misc_feature (1429)..(1429): n is a, c, g, or t
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgattgcaaataccccccaggggtcattggggtgaggggagggatttanaaa

SEQ ID NO: 281695 - DNA, 1594 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctggtaatgtggcggaaccttacgcaaggcatttccccttaagggcctggctgcaacccttgttttctggggctcgttttcgtggctcagaggggcgggactgattctggcctactttcctgatgctctgatccttctttccagattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281696 - DNA, 754 bp, Homo sapiens
gcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggttagcacgggctctggttctgggactgaggggcagtcaagcagcaagatggagggggtggggaactgcagctcccggcagcctctgggctttgtgtgagtgccccgcgggctgccgggagctgtggttccgcgggcgggcagcctgggctgcgcggtctgagcgcttgttacaccccgcgcagggattcggacggagagcgcgaggactcggcggctgagcgcgcccgacagcagctagaggcgctgctcaacaagactatgcgcattcgcatgacagatg

SEQ ID NO: 281697 - DNA, 562 bp, Homo sapiens
ggaggcctggccccgcggtcgcagccgccaccgcccgccccgacctcccggaccgccgcggggccacgggcccgagccccggattcgcgctccggattcgcctcggctcggccgcgcgtatatttgccttccctccatgatctccaacactatccgataaagtagaagcaactgaggtaccgtgaaagagaaaggagctggaactgagaaaaagcagaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281698 - DNA, 1453 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctgattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281699 - DNA, 408 bp, Homo sapiens
  misc_feature (41)..(42): n is a, c, g, or t
tggcgatgtggccccgttgtggccacccgccggccaccgcnncggcttcagcatcaccacggaaagattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281700 - DNA, 259 bp, Homo sapiens
gggaactcctgcgccgagcccaggatgacattgcagtcacggtcagtgcaggagttcctcaagccgtcgggtcagtgcccggggaatgcacacccgcctgattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 281701 - DNA, 1917 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaaaaaaaaaaaaaaaaaaaaaaaaaaaaaaaaaaccggagagcaacaaagaggaggggggcggaaaaaaagggaaagaaaatgggccaggtgcacaaaccggaaccggaccccagtttcttgtaccaagggggaaacatgcggggaccccaatggcgccggaacaaatgcgaaaacccgggttaccgggttaaaaggctgcaaaaaaaacacacaaaacgccaacaacaaagacaagcaaaaaagcactaaacagacgaacacaaatcacacaacagaaggagagaacaccacaacacaaacacagggaacagagaaaagaaacaaaacggaaaagcaaaagcaagaagaggaacgaaagccacaagagaggaagagcagacaaggcgcaaggaaagaagaagaaaacgaggatagcaaaagagaggatcagcgggaagcgcaagaaagagacaaggaacaaaggcagagagaagaacaggacgagaacagacaaa

SEQ ID NO: 281702 - DNA, 1763 bp, Homo sapiens
caaaccagtggctgatatcctggcctgcaacttccacgatgggtttcagcagcaggttcccttgaaaagagcagcacagccactgtcaatgccagcccttcgagaaccaggcaaacgcgcgcgtgcacacacacacactccggccccggcccaacgtgtggcccttacccttgtattcctgtgccaatgacgttaggtcgtacacgcgtcccaggtaagatacccagaggtcttcgggcctgttatgttgggccacctccgccggcgtgaaatagcgacgctgaaaatactccaagtctggcccagccaccaggccccggcgcggcatggctcttgctctgtcggtcactggatctcttggttactcctttgctcctcagcacgtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaaaaaaaaaaaaaaaaaaaaaaaaaaaaaaaaccgtgtgtgtggggcggcccggggcccccggagagaaagttttcagagagacccatgcgggggggggcgcgggggccccaggagagggaaagggaaacgtggggccaaaagggggttccctaagggaaaccgggggccaggaaaaaggggcgggggattcttccccaataaaaaaggccgggggggaaacgcggagggtggggaaaaaactccgaaggggggctccggaggggccaaaagggggaccaactcaaggggggtcccaggggaacccgaaattcaaataggccgggggggggaacggaaagga

SEQ ID NO: 281703 - DNA, 1185 bp, Homo sapiens
cccaggagtttgagattggcctgggcaacatagggaggccccatctctacaaaaattaaaacttagctggttgtggtggtgaatgcccgcagtcccagctactcagaagactgaggtggactacgtgagcccaggaggtcagggatgcagtgagccgttgacagcaccactgctccagcctgtaggacacagcaagaccctgtttgactcagtcttaaacaaaaaaagcccagaagggagggcagagattccagaaccagaaagtggatgagacttgagagccccggggggtgagcatgagtgggattctctcccaaccctggacgaacgggtggagatcccaacacggagaatcagttctagttggtactactggagctagaggcagggggaattccctagtgtcctctcttcagctcctaggctcagaacttccctgtctccctctcaaatgagcagaagccctggaccaggcgggggtgggaggtgctgaaagcccctgacatagggcctggaagggatctcataaacttagacggagctggtctcaggaagtcagcctgggatggatgagggtttccagaaaggaggcggagtccggggcgccacgcagggaagggcgggcttccccgcggcctgaattggacaggggtcccctccagccctgtgcacgagaggatgacaggacccagggtggacgacaggacccgggtggacgagggtcccaggagaagcgcggagcggccccgggtcgtgggctcggccctagcgcgctctcccgcctcacgcccctgttccacccccagaccaggatcgtgctgattctccccctggacaagcggcagccgctggccaacgctgggcaacggattgactacgcgtccggcgctgggctgggctccccggcggcacccagattgcgcggagcgggcgaaggtagcgagcgcgagccgaggatgccggtactgctgctgctgcggcggcaagaggcgcggcggccggaagagggcggggccagggcagctctgagctggccgcggctgctctcgcgcttccggtccccggggaaggctccccgcgaagccggccccgccgaggagcagccgcgcaaacggtgccgctgccctcgcccgcagctttaaacgcttggcccggaccccgcccaataaagagtgcgtggcaacc

SEQ ID NO: 281704 - DNA, 572 bp, Homo sapiens
tgccagggcccagggggcagagcagacggagtgtgggccatcgtccccagtggtgaccagccctgccatgggaaactatagttcccacaaaaggaccaaagcacccaagcaggcccgcaaggagaggccggctgacatggacaaggcctggtggaaatcgttcctcaaccacctcactcggaagaagccggctaccaggatcgtgctgattctccccctggacaagcggcagccgctggccaacgctgggcaacggattgactacgcgtccggcgctgggctgggctccccggcggcacccagattgcgcggagcgggcgaaggtagcgagcgcgagccgaggatgccggtactgctgctgctgcggcggcaagaggcgcggcggccggaagagggcggggccagggcagctctgagctggccgcggctgctctcgcgcttccggtccccggggaaggctccccgcgaagccggccccgccgaggagcagccgcgcaaacggtgccgctgccctcgcccgcagctttaaacgcttggcccggaccccgcccaataaagagtgcgtggcaacc

SEQ ID NO: 281705 - DNA, 605 bp, Homo sapiens
acttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcaggtaagggcagctccgggctgggatcatttggcctcctttcctggcccttctctccggctgttttctgggagtcaggcgagtgtctgtagtctctgctcggggtttggggctcaggaatgatgtcatgctccaacagttggattctattagcttaaggaggagggaaacagccaattttcttgactttgcaaatctagctgatctcactcttgctgaatctgaggtgtttagacttcactctaaaaagcatcattttacttttatttagcacaaaggcacaggatatttttacaggaagaatcttttatatggaaaaatctgagttaacatcactcccgtggtgtttgtagttcttacagggaaactccagtgccttttgagccgcttgttcgtcctagtgaacactgtctgttttgtctcttggtgctgctatgtctgacctgtaatg

SEQ ID NO: 281706 - DNA, 810 bp, Homo sapiens
  misc_feature (678)..(678): n is a, c, g, or t
  misc_feature (780)..(780): n is a, c, g, or t
  misc_feature (782)..(782): n is a, c, g, or t
  misc_feature (809)..(809): n is a, c, g, or t
cctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaaaagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcaactgagtctgccgtcctcaacctccaagcctcaatggaagacaagcctcagcaacaacaagcgaanctgctgtccaaaccgccgggcccggccgcaatcccaaagcttgtccaaaaggaatttaaactcccatcctacaaatggccaaagaagaagggaaagtaagangnatttaaaaaaaaggttgtcccaaggtnc

SEQ ID NO: 281707 - DNA, 862 bp, Homo sapiens
ctcagaggatcccgacgctctctgtaggggtgacgcttctcggtggggtgacgctctctctgtggggtgacgctctctctgtggggtgacgctctctctgtggggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaaggggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcattccggagaagatatcagcatgggaaggtc

SEQ ID NO: 281708 - DNA, 4740 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagtcctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacacccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcagcccacagcctgggcatccgggagaagatatagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtcgaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgagaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281709 - DNA, 2839 bp, Homo sapiens
cagctgcatgactcatgagctgaggggccaggcagaagccattctctttggttcacaggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281710 - DNA, 2091 bp, Homo sapiens
actataccaccctataccaccctgataccaccaacatatatttattgagtacctactgtgtgccaggggctggtggggtggtataggaggctctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281711 - DNA, 2422 bp, Homo sapiens
  misc_feature (46)..(46): n is a, c, g, or t
tagtgcctggtctggcttggtctcctgtgcgtctctcagaatgctngctctgcccttgtgaagaaatctagcccaacagctggaatgagctgggtacagcagttccaagaggcccctcctgtgtaccagccatggtcattgtcagccaacaaagcccctgactgcccagctttggtgccctggcctggcctgaccttagtggcccctaagagagcctggaccatgaggtttcttttcctgaaggttctaccctctaattcagggctgagcttcctctttgccaccctgcccccccccaggccagctcccgtggggctgtgaatacagctattgtttcctgtggttgcagctgcctctgagcacattccaggaccattctgggagggacgatcccaaggtcttgttcttggcctggccgggtattcaagttctgccaatctggggtcttggaaaagatgtccttcctgttctgcctggggtctgcctctggctggagaggggaggggtaggtccagccagctcatgatccgttgctgatgttttaggttttccacaagttctttgtccctcttgcctagttctgatgtggggtgggagagggtacccacgatctgcattcactggccctaggggtttacaaaacctactgcctcctcagccacgggcccactgatgtgccccccaaacccgagacagcccttttccagatctttgtcagatgactgtcctgcgggttgctgcataccttcctggctgtttgcaggtacatttccctaagagagtagcattgttgtccttgaggcgctacgcagtgggaaagcggggactttaccagtctgcagggtccctgaaccccattagcatttttgttgcactgggaggtttacgatcaaaggctgtcctgagcctccagcgagctctaagttcctgggcctgggctcaggtactctgtctctctgtctgcccatcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281712 - DNA, 1791 bp, Homo sapiens
caatcatggaggcgcggaggacaggaattaaggtgtgctcgccaggagccggggtagagcaaggccaccgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281713 - DNA, 1633 bp, Homo sapiens
cctgacacccttcctctttgggctgctggcggtgggcacaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281714 - DNA, 4158 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagtcctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacacccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcagcccacagcctgggcatccgggagaagatatagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtcgaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgagaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgcctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281715 - DNA, 909 bp, Homo sapiens
agttggttgaatctataaacatggaacccatggacgcagaactcatggatatggaggacaggctgtatttaccatattgcattacaaagaggaatcccaggttcccacatacatcaggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281716 - DNA, 4493 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagtcctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacacccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcagcccacagcctgggcatccgggagaagatatagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtcgaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgagaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgcttgttccgctgggaccggctcgatctaccttt

SEQ ID NO: 281717 - DNA, 508 bp, Homo sapiens
gatcctgatctgtcgtgcagcacgtcagtgcagtacgcttagtctgtcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281718 - DNA, 2808 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagtcctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacacccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcagcccacagcctgggcatccgggagaagatatagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtcgaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgagaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281719 - DNA, 778 bp, Homo sapiens
tctggctgatgaggaccttggtctcactctagcgtcttttctaccccaggtagtttaggaaggaaaacccaaagacatgtggcaaccccaaagatactttctgctgacagaaaactaattattcctccttctgaggccttgcctcaagccattgcaggagatgaaaggcacttcctcttccttggaagccagaaaaatcacttagggtgagggatatgatgaaagtggtgctctggtttctactttaattcatccagcaattatgtttcaacttccatgttcagaacatagtttctggccttctgcagctcgtaggctagttacaaggctatgagcacaagaaagcaagcttccagaggccgggtgtggtggctcacgcctgtaatctcagcacttggggaggccaaggcgggtggatcacctgaggtcaggagttcgagaccagcctggctaacatggtgaaaccccatctctactaaaaatacaaaaagtgcacctgtaatcccagctacttgggaggctgaggcaggagaattgcttgaacccaggaggcggaggttgcaatgagctgagatggcgccattgcactctaacttgggcaacaagagtgaaactcggtctcaaaaagagcttccagaacagaagagtggtactggctggaagtcttgttggggagaggaagactacaccaggaagattgaggaaggctttgcaggctcttgacctgaacctcaaagattgtcttttcccttccagaatgtaataccctcaatgggct

SEQ ID NO: 281720 - DNA, 164 bp, Homo sapiens
tagcagggtagacgagagacctggaaaagagcaggttggaaggggaaagcagctccagttgcttcgtggagggccagagggcagcacccacttggctggccccggcccactttcccatcgctctcctgcaggtgttagagctgcggcggcccatggactcaagg

SEQ ID NO: 281721 - DNA, 362 bp, Homo sapiens
catagcatgtttctgtttaaagagaaattgagaccaaagaggttaagtggcttgcgtaaaaccacacagtgattaataccggtgccctaattagagctctcacgtgttttcactaccctggatcagatcacagttataatccagtcttcctaatccttcctctcccactgacagggttagggctacaaggaggagagggagtggaggttggaagggataacactgaacattctctcttgtcctctctggcccacaggcaacaaaatgaagtttctccacaagaagaattaagcctccttctcagtagcagagtccagtgccttgcagagcctgaagcctggggagaaggcccagcctgggac

SEQ ID NO: 281722 - DNA, 702 bp, Homo sapiens
acttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcattccggagaagatatcagcatgggaaggtc

SEQ ID NO: 281723 - DNA, 914 bp, Homo sapiens
gggggtcgggggtcgggggtcgggggctgggggctgaggactgagtcgagccagcagcccagggcatctgtccacgctgtcagaggagcctctgggcgtggggctggcccttagagggctactgcgctgcttaacttgcctttcacagaaaaccactggaggagatactcacaaaaatgaaggggaagaacaggaaacaggaagacatgagatgaaggaaacaggagattcaacatggatttcacaccctttggagagtttctttcttggataattcaggaagatgagagactgcttaggcgccaccactagtaccatgagtccctgcactggttaaagccatcgccacaacctggacaggcagcaaggggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcattccggagaagatatcagcatgggaaggtc

SEQ ID NO: 281724 - DNA, 797 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaaggggctctgggtttgcagagagccgaaatgaccatgactgccaacaagaattccagcatcacccacggagctggtggcactaaagcccctcgggggactctgagcaggtctcagtcagtctctccacctccagttctctccccaccccccacagagagagcgtcaggaaacgaccctgcaggccccacagagagagcgtcgctttgtgagcttcccctgaaggacagacttctccttttggggtgcgttggctttcttcttctcccgctcctccatctccccacagagagagcgt

SEQ ID NO: 281725 - DNA, 3252 bp, Homo sapiens
ctcagaggatcccgacgctctctgtaggggtgacgcttctcggtggggtgacgctctctctgtggggtgacgctctctctgtggggtgacgctctctctgtggggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281726 - DNA, 4695 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagtcctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacacccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcagcccacagcctgggcatccgggagaagatatagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtcgaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgagaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281727 - DNA, 2200 bp, Homo sapiens
gcacgtcctctcccccacgccagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281728 - DNA, 1639 bp, Homo sapiens
ctgcatagcagggtagacgagagacctggaaaagagcaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281729 - DNA, 985 bp, Homo sapiens
gggtgtctagaggatccctttgggtcttgctctgacgtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281730 - DNA, 550 bp, Homo sapiens
aagatcgtaggatcactaatagttatccgcagggatgcgggctggtgactggtccggctatatacatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaa

SEQ ID NO: 281731 - DNA, 2556 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagtcctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacacccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcagcccacagcctgggcatccgggagaagatatagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtcgaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgagaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaaggtaccctccccagaggcagcccactggagccgggcaggtgggcgggcaggcagccagcctttctctctctttcctggcttccttccttccctaatctggactgcttcctcgattccctttgaataaattctgggtccgtgca

SEQ ID NO: 281732 - DNA, 634 bp, Homo sapiens
ttctaggtgttctgtgggcccatcaggcccttgtgaagaaatctagcccaacagctggaatgagctgggtacagcagttccaagaggcccctcctgtgtaccagccatggtcattgtcagccaacaaagcccctgactgcccagctttggtgccctggcctggcctgaccttagtggcccctaagagagcctggaccatgaggtttcttttcctgaaggttctaccctctaattcagggctgagcttcctctttgccaccctgcccccccccaggccagctcccgtggggctgtgaatacagctattgtttcctgtggttgcagctgcctctgagcacattccaggaccattctgggagggacgatcccaaggtcttgttcttggcctggccgggtattcaagttctgccaatctggggtcttggaaaagatgtccttcctgttctgcctggggtctgcctctggctggagaggggaggggtaggtccagccagctcatgatccgttgctgatgttttaggttttccacaagttctttgtccctcttgcctagttctgatgtggggtgggagagggtacccacgatctgcattcactggccctaggggtttacaaaacctactgcctcctcagc

SEQ ID NO: 281733 - DNA, 435 bp, Homo sapiens
ttccccaaacactggaaactctctgatgtgcccttctgactgcagggtaggaatcagcaaaagtatgttcagaaacttaattgcccaagcatcttctttagtggtgactgggacagtcacaagatcatgaagttctagttctctagctaggtgtatgctggcaccagtgtccaacacagctgccttctcaggtgccaagaaaccaggaagctccttcccatatgctgtttgcagttcacaccagttctgagtagccaggtccagaaactccaggaactctgagtcactcaagtctgagaaccctgaggcttctgctgacactgtctcctcttctcttgtctctgccatggtacagctctggattgggctagaagggccctgcataacatgttaaagaaatgcattgttcaaataaaaacgttctcaaaagcaaat

SEQ ID NO: 281734 - DNA, 2087 bp, Homo sapiens
atggcgccggaggagaactcggggagcgaactcttgctgcagagtttcaagcgccgcttcctggcggcgcgcgccctgcgctccttcccctggcagagcttagaagcaaagttaagagactcatcagattctgagctgctgcgggatattttgcagaagcacgaggctgtccacacagagcctttggatgagctgtacgaggtgctggcggagaccctgatggccaaggagtccacccagggccaccggagctatttgctgacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaatgaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacacttggttcctcacaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgtctgtccccaccccatcccaggtcaccacctggctgaacccaggtccccgacccaaaaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaagcc

SEQ ID NO: 281735 - DNA, 2127 bp, Homo sapiens
atggcgccggaggagaactcggggagcgaactcttgctgcagagtttcaagcgccgcttcctggcggcgcgcgccctgcgctccttcccctggcagagcttagaagcaaagttaagagactcatcagattctgagctgctgcgggatattttgcagaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgtgagcccccacgcccacccgggcctgcatggtccccaagctgtccctacaggactccagtggaagtgaaagaactgggggccggggaaaagctaggaagccccacactcccacaccatgcggggaactagggcagaggccggctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaatgaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacacttggttcctcacaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgtctgtccccaccccatcccaggtcaccacctggctgaacccaggtccccgacccaaaaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaagcc

SEQ ID NO: 281736 - DNA, 934 bp, Homo sapiens
atggcgccggaggagaactcggggagcgaactcttgctgcagagtttcaagcgccgcttcctggcggcgcgcgccctgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcagtcacactctccaagagcacagccatcatctcccacggcatcacagtcctggtcacatgggatgccgccctctaccttgcagaatgggccatcgagaacccagcagccttcactgataggactgtcctagagcttggcagtggtgctggcctcacaggcctggccatctgcaagatgtgccacccccgggcatacatcttcagggactgtcacagctgggtcctctagcagctctgagggaatgtccttctcaatggcctctcattaggtgcagatatcactgccaacttagacagccccagggtgacagtggcccagctggactgggacgtcgcgacggtctgtcagctctctgccatccagccagatgttgtcattgcagcaggtaatgcccagccccgggcatcctgtgcaggcggtgtccttgcagctctaaccagctcttggctctgggaaaagggaacaatggatgctgttgggcatggacatgatggggcttccagaagagttactctgggcctccagggtgacatcaaaggacaggggtgcctcttaagctgaccttcaagccacagccctcttgttggagacaggcatactcccgttacagtcgtcaccacatggctctgtcccagagccatgcctgtgtgtttcagagaccacaggaggaaaacaacca

SEQ ID NO: 281737 - DNA, 965 bp, Homo sapiens
accacaaaggaaaaacatagcatattgaatcatcacaaggcagccaccccttcatagccacacccggcccctggccacaactgacctgtgctccatcgccagaattccattgtctcaggaatgttcaatgaatggaatcctgtgtggcctgagatgagtgtctttcatgtcctgtcatggtttattcagccatgtggtggatggctgcttgtcttctaagccacttgccttctgatcgctggactgactctctcgccttctcttggtgctgccctcgggaggctcagtcacactctccaagagcacagccatcatctcccacggcatcacagtcctggtcacatgggatgccgccctctaccttgcagaatgggccatcgagaacccagcagccttcactgataggactgtcctagagcttggcagtggtgctggcctcacaggcctggccatctgcaagatgtgccacccccgggcatacatcttcagggactgtcacagctgggtcctctagcagctctgagggaatgtccttctcaatggcctctcattaggtgcagatatcactgccaacttagacagccccagggtgacagtggcccagctggactgggacgtcgcgacggtctgtcagctctctgccatccagccagatgttgtcattgcagcaggtaatgcccagccccgggcatcctgtgcaggcggtgtccttgcagctctaaccagctcttggctctgggaaaagggaacaatggatgctgttgggcatggacatgatggggcttccagaagagttactctgggcctccagggtgacatcaaaggacaggggtgcctcttaagctgaccttcaagccacagccctcttgttggagacaggcatactcccgttacagtcgtcaccacatggctctgtcccagagccatgcctgtgtgtttcagagaccacaggaggaaaacaacca

SEQ ID NO: 281738 - DNA, 260 bp, Homo sapiens
catagatacagaaaaccacaaaggaaaaacatagcatattgaatcatcacaaggcagccaccccttcatagccacacccggcccctggccacaactgacctgtgctccatcgccagaattccattgtctcaggaatgttcaatgaatggaatcctgtgtggcctgagatgagtgtctttcatgccacgtgacacccttgaggcctgtgcaagctgttggcatgtcaacagttagctgcttctcattgctgagtggcgatt

SEQ ID NO: 281739 - DNA, 1985 bp, Homo sapiens
atggcgccggaggagaactcggggagcgaactcttgctgcagagtttcaagcgccgcttcctggcggcgcgcgccctgcgctccttcccctggcagagcttagaagcaaagttaagagactcatcagattctgagctgctgcgggatattttgcagaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaatgaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacacttggttcctcacaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgtctgtccccaccccatcccaggtcaccacctggctgaacccaggtccccgacccaaaaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaagcc

SEQ ID NO: 281740 - DNA, 463 bp, Homo sapiens
ctgagatactctagacctccgctcatctggaaaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagta

SEQ ID NO: 281741 - DNA, 821 bp, Homo sapiens
caggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagta

SEQ ID NO: 281742 - DNA, 505 bp, Homo sapiens
actgggggccgtatcccaggcccaacagccctgggacgaaggtgtgtggcaggaagcccccagccagtctgaaccctgggggcagtcccaggagccacccgccatgccacgacagcttccccacgccaggcagcatgcacccctccctctgggatcagcagactacaggcgtgtcctcggtgtcaggccacgggggccacacagggaccccgaggactccgagatgcaggcaggtggggcccagcccggaaaggcctgcgtgggctcactggagatgctgaccgcgtctgttttcctttcagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtg

SEQ ID NO: 281743 - DNA, 522 bp, Homo sapiens
attaaaaaaaagagccagtgtctttcgcataggatcttttacagctggtggggggaagaaagggatgttagtgtgtggagggtggggtggtgcgggatgagcaaaacaggaactccgaatgtacacataacacctgttttgttgttcttgtttatgcctgtcgtgcatctattacacttcctcccttaaagaccttaagggtattttaacttctcactctgcttgaacctccttaagggtattttaacttctcactctgcttgaacctccgtccttcgggacgcaaggattcagggagcttcctttcctggctgcgagggatcttcctgagcagagctctccgggttccccggctcgcggggcccggcgaagggcaggtgggtgcggccgtgcgggtgctgggggtgcggcgccccaaggggcgccacctcgtgcggcaggagggtcgcggcggcggcgcccgccttctcgggagggggcgacaacaccgaggacaggcaggggaacgcggcggcggcggcg

SEQ ID NO: 281744 - DNA, 656 bp, Homo sapiens
attaaaaaaaagagccagtgtctttcgcataggatcttttacagctggtggggggaagaaagggatgttagtgtgtggagggtggggtggtgcgggatgagcaaaacaggaactccgaatgtacacataacacctgttttgttgttcttgtttatgcctgtcgtgcatctattacacttcctcccttaaagaccttaagggtattttaacttctcactctgcttgaacctccttaagggtattttaacttctcactctgcttgaacctccgtccttcgggacgcaaggattcagggagcttcctttcctggctgcgagggatcttcctgagcagagctctccgggttccccggctcgcggggcccggcgaagggcagatccattgtcatgacttctgagctgtttgaaagagaatgttctcagaatcaagatgtgccagtaaatatgaattggttggatttgacttctcaatgatacacaatgattctctacctggactaacaccacagaggatgccatagaaacttctgagatttcgatgataaatataaaaagttgaagctttggggagcccaagccaggaagctggagacactgtggcagaaagtgaaagaggaagaagccattcgacgtctgtttttaaaaatgtgttctgt

SEQ ID NO: 281745 - DNA, 2384 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcaaaaaaaaaaaaagtcgacgcggccg

SEQ ID NO: 281746 - DNA, 2359 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281747 - DNA, 799 bp, Homo sapiens
taaggctaggtaggaggctgggtggttaatcggccgaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagcgctacgcatgaagggtacccttcctag

SEQ ID NO: 281748 - DNA, 500 bp, Homo sapiens
  misc_feature (27)..(27): n is a, c, g, or t
tctgcccatggcgtctgccagagcccncaggcaggctggcctactaattcccaagactcagagcctaatgcccacttgggagagggatagaatgacttgagggcagccagtgcttaagccttctcccttatgcaaacagccactttgtccatgggctgttagcctcaaaggggtggggaaaagcccatacctcctgggccagtcctagccctctaggcctctggctacaggcccagcctctgcagtcacatgaggtctccactgaactctggctgctgaggcttgcgggaagattcgtgagcatggagctgcctggggtctgtgtgggaggcaaacctaagaatctttgaagtcaaagcaaagaaaacaggaattagaggtcaaggggttgaagaccacctttgagatccgagatctggtcacacctaaagtcattaaaatcactgaaatgtttagatacacagcccaataaattctctttataaaacacaaaaaaacta

SEQ ID NO: 281749 - DNA, 2323 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaactcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281750 - DNA, 2036 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281751 - DNA, 2381 bp, Homo sapiens
  misc_feature (2333)..(2333): n is a, c, g, or t
  misc_feature (2365)..(2365): n is a, c, g, or t
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgttattcttagaactaaanaagagggtttatccccaaaaaaaaaaaacatnctatccactataaaaa

SEQ ID NO: 281752 - DNA, 1894 bp, Homo sapiens
aagtacacgcacgagagacgatcataccagaggagcgaccgaaacctcagacacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcaaaaaaaaaaaaagtcgacgcggccg

SEQ ID NO: 281753 - DNA, 2059 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281754 - DNA, 192 bp, Homo sapiens
cctatccgaagtgaagggagaagggacaggaggagcctgtctcaaccctctctcctctccatattccagagtccggctctgaagcctccagcccagactactttggacccccagcaaagaatggggtggcagcagaagtcagcccagccaaagaggagaatccaaggcgagcctcaaaggcagttgaggaga

SEQ ID NO: 281755 - DNA, 822 bp, Homo sapiens
agcgggatggggcgcggtgagcgcagccttggtgcatagtttgccctcttggcgcacacacaggtggatgaagccgcttccagggaagacaaactggaccttaccaagaagggcaagaggcctcccaccccttgtagcgacccggagagaaaaaggttccgcttcaattcagagtcgggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281756 - DNA, 422 bp, Homo sapiens
ctacaacaaaataagcggccgggcgacaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281757 - DNA, 3034 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcatcaaatttggtcccccattctcacctcctgtattttgggccaggaaactgagcagtagtcactgcctccacctcctcccctggcctggttccctttaatttcccccgggttcctggaagaagtccctgcctccagaccctgtcatccaacagccaccagacccttttggagaagggtgtgtggctcctgtgctgcccgcctaccccgtggcccctctgcttttagcctagtctgataacctaatgcccacttgggagagggatagaatgacttgagggcagccagtgcttaagccttctcccttatgcaaacagccactttgtccatgggctgttagcctcaaaggggtggggaaaagcccatacctcctgggccagtcctagccctctaggcctctggctacaggcccagcctctgcagtcacatgaggtctccactgaactctggctgctgaggcttgcgggaagattcgtgagcatggagctgcctggggtctgtgtgggaggcaaacctaagaatctttgaagtcaaagcaaagaaaacaggaattagaggtcaaggggttgaagaccacctttgagatccgagatctggtcacacctaaagtcattaaaatcactgaaatgtttagatacacagcccaataaattctctttataaaacacaaaaaaacta

SEQ ID NO: 281758 - DNA, 1931 bp, Homo sapiens
taaggctaggtaggaggctgggtggttaatcggccgaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcaaaaaaaaaaaaagtcgacgcggccg

SEQ ID NO: 281759 - DNA, 1421 bp, Homo sapiens
tgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcgggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctca

SEQ ID NO: 281760 - DNA, 574 bp, Homo sapiens
gaaagaggagggacagctggggccctaggagctccccctgagggtctgtccctgggaacggggcgctaggacgggcactccttctggctggaatgctacgccggtgagggaaaggagtccactagggaagtacctggaggtggagacggggagagaaatcacagaaactcagtttacaaacgactgcttgggagcagtcatgtcacccagtccagagggagccggtcagctgcgttccgcgaacttgggaggcgactgctggggtagcggcggggccctcactgcgcgtcgtcagggaccagaccctggggtggccccgaagcgtcgagactacaactcccgggatgccgcgggccaggctgcatcccgcctgcgcagaagtggtggcaactccgcccctcgccaggcggcggcgctgcggactcagtcctaagcgggcgaaggcggcgagcgccgtgggtctgggcgggccaggagaaccgggtgcttcgaggagatctgcgggctgggttgggggcgtttgaccccttggcttgtcccagtgggtaggcgggactccaacccccgcctcctc

SEQ ID NO: 281761 - DNA, 493 bp, Homo sapiens
gcggccgcggtggcccgcggtggcagaagttgcaagagaggctcctggcctactcaggggcgccgcctctccgagttttgcggcccaaggcttgggcgaatcagttcacatcaacacccctactagcctctccctccggggtcgaccatttatctccagcagcggaccaggcgcccgggccagggtgacatgcgcgccctgcctacacgcagctcggatcctctgctgtttctggagaggcctccacaggtagaagctccctggaacaactgctggaataaggttccagagtggaaggtggaagctccctcttgggataaaggatccacagtggaaaaaaaaaaagttgccctctgctggaaaacagcatctttgtcctctgagaaaaacagtctcccttcttacggaggccagtggattccatcctagaggctgtgttgaccgtatctccaaatagacaataacgaggcatcttgattcccacaactccagc

SEQ ID NO: 281762 - DNA, 705 bp, Homo sapiens
gcggccgcggtggcccgcggtggcagaagttgcaagagaggctcctggcctactcaggggcgccgcctctccgaggtggggcgtcctcaactttcctctttcttgagcccggcctgctccgggctctgaggggcgaggacgcttcacgtggtggcctggggcccaccccgcctaggaaaggcggatcctttacgtctgaccctctagcaacccctgggccggtctgggaaagttccccagctgcacttctgggaaatgcagaggctgcctgccgctttctttcgcagttttgcggcccaaggcttgggcgaatcagttcacatcaacacccctactagcctctccctccggggtcgaccatttatctccagcagcggaccaggcgcccgggccagggtgacatgcgcgccctgcctacacgcagctcggatcctctgctgtttctggagaggcctccacaggtagaagctccctggaacaactgctggaataaggttccagagtggaaggtggaagctccctcttgggataaaggatccacagtggaaaaaaaaaaagttgccctctgctggaaaacagcatctttgtcctctgagaaaaacagtctcccttcttacggaggccagtggattccatcctagaggctgtgttgaccgtatctccaaatagacaataacgaggcatcttgattcccacaactccagc

SEQ ID NO: 281763 - DNA, 609 bp, Homo sapiens
cagtggtcttcatttccgacctaagagtactttgggaaagtgttcttaggtttgatatacttctacagtatcttcattttcattattaaaggtacctattaactttttctttcctgagctttctgcaacttgcctattaattctataatctccattccattctagatctagttctttttcagtatctatttaggaagaaaggtgtaagaactttatggatgcagtgttagaaagcagtccctttaaagtaggaactgggtctgtggtgaggcatgtaaaaatcttaagatatgaggagaaagaaatagcagctaactttggccatgtagcaggtgctattcttcattaatcaggtttgtttcgtaatgaaactttgatagtacttccactctctaatagataaataagtacttggaagttcgtattgacttgttacacaaggtgattatagttagtagtggacacaaaatgctgcaatacagatcttctatacctaacttattgaatttgttatgtaatgatgtaataaacttaatttttttcaagtagtttctacaaacaagtagttaaaagtcaaggaatgggaagtttaatcatacatattacact

SEQ ID NO: 281764 - DNA, 471 bp, Homo sapiens
tccggtcccggagttgaatagtttttgaagtaatgagacgggaacgagacttgggacgaactggagaaaaacataaccgcgaaaggaggaggcggctatcacttactggctgtgtcagaagtcgccgggaacgcgttgctcccgaggccgaagggcccagagagctccagccaggcagcgggttcgtctccggcgcaagaaggctggctgtctttagtcaagtcaagctcattctgaagcctttcctgggagtcctgaagactagcaataagtccttctgcagagccaagaccttgttcacttttccttaccatatcttggaggtggccaatcttgtgacgacacatcaagaaggtgaccacctgcaagccaggaacagagcgctcactgtggaactgaattggctgctaccttgatcttggacttcccagctcccagactgtaagaaataaatttttattgtttgagcca

SEQ ID NO: 281765 - DNA, 3555 bp, Homo sapiens
  misc_feature (1563)..(1563): n is a, c, g, or t
gaaagttttcactgcatctcttgtgggatacgtataatgtttggcagatgatacttttaaatgacaataacaatagttatttttcagagagaggaatcaagatagccctgcaaattcagtgtagttgttaattctctgtattcttattaacaagattcctttattcatttatttatcaaatagttatcgagggccttatataccagacatcagtttaggtgtttaggatacattagagttaaaaaaagacaaaaatccctgccctcgtcaacttaaattttagtgagggaaacaatacataataaacataataaatagtaaatgacatggtatgtaggaaagtgataagtgttatgggaaaatcagagggaaagggggttagtgagtgctgagggaatgtgggttgccattgaaatggagtggttagtatatgcttcattaagaaggtgtcatatgaataaagactttgaaagagatgtatgagttaccaactgctacataaaaaactaccccaaaactcagtggcttaaaacaattaaacatttgttcactcatgaatcagtagatctgttagttcttagtctgagccaggcttgttttttctctatagggcttgctcacacagttatggttagctacaggttagctggtggctggctttgctaatcttggctgggttctttcttacgtatgaagtcccatctgggacaacttgactcagcctcatatgatctttaattatccttcagtaaactagcctggacctgttctcttggcacaataggatctcctgaggtttgggctcagaaccagcacaatgttacttcgttatattctgttgctcacagaaagtcacaaggcaagtccagattcataggctggggaaatagacttgatctcttgatggaaaagctgcaaagtcacattgcaaaaggctgtagatactgagggggacagccatttttgctgtcttccacagaaggcaagggagtaagccttgtgggtgtatggtgctggaagggatgggtgaagagtggaggaggtggcagagtattccaggtagacagaatactctgtgcagaggctctgtgagagtgtactggtgttaaaagaacagaggctagagtgtctcaaatggagtaagtgaggagagagttgtaggagatgaaaccagggagaaacaaggacaaaatcaggaagaggtttctttttgccataattaggacttgggcttttgatcagagaaatgaggtttccccctcgttttttgtgagttttattctccatatataaggtcaagattttatcttaatctttcattttcagcagtttgactgtgtgtctaggtagtttttgtttttgttgttgatgctgttgcctgggtttttttgttttttggtattaatcctgcttggggttctctgagcttcttggatatgtggcttgttgcctttcattatttttagaaaatcctctgccttatttcttcaaatatttcttctgccctctttcttcttcttccacttgtatggtacctgacatctcttcctgttctgctccacnacaggtaagccagtgcttgcatctcgtctctcctgggaaagatctgtctttccttggattttaagcttatagttgtcctgtaaccccagctctgatgggatcaagaaaagttatgattttgtagttcattaactttttcttattgttaggaaaggagcaatattctcccaactctgctccattagagggttttgagtagaaggcaggacataatctgatttatattttaacaagagcagttaggttactgtattgaaagtaggtagaaggcagggttggctctaacgaatttgaatgaggagcctcagcacttttcggcgccattttcgagtgatacctgatctcatcaatctagcggaagagacaggataacctatccaagagtatagcgccactatgactccgccggaaaaattactttaaaaatcgccaaaaattacttggagcaaagggcagtaggcggagcttcgccaaggctggcgcagtcggttttgacctgtagcagagaaccaattctggagaacagcctcacttctttgattgaatactcacataatgctttggaacaggacatgagattaaggtttaataatgatagaatgaagaccataataaaagagacctctacttacctcagcaattcttacctttcttacctatttgatgaagatgtcttttgaaaggtgtactgcaaggaacaaaatgtttgtaaattctgcttttaccaaggtttcttttttagttgatgccaaagagttccaatattgaacatcttaagtctgttacttggagtatggattgagtttggagcttactcagaggactacaggagagtatccaggaggtggataattactgtaccttcctcatggaaaaagttttatttaaagtgttatttctcgttgaatactatcaaaaaggaaaaaaaaatgacctaaacttttgagacagatttggctctagtaagtatttagatatatcgcttgcatatctgggagaagaaataagagactatcatcaatacattcccatctactaaaaaattttattttacacatgtcaagggattacttataacttccattgtcttttttttaagcctatatgcaatgaaaaatatattggcaaaataaatatttaaaccttttatgttaaaattactgtgaaagatgacaagttagctgctgtttttgtctacattatactgaaattaaatgtttataatttatattttgggtttatttatttataaatcatggaatttatgcaaaaaacatgagtagtacagattctcctctaattctgtaggactttgaataatgtgatatttttcttatagttggacccttgtgttttgaagaaatgccaactgcttgaagaatttccttgttatttgtattatttgctatagggttagatgttgagaaattcttctgacaaaaaattttaagccagttttacactaaatattccttagtctgattaatttgttattggatgtattctgtatctttcttttgtaatttgtaacttttatccacttagcacgaatgattctattgaagaaaatctttaggaagtggtagaaactttaaatcgccccatagtttgcctgtttccacattttattatcttataatctttgggagtgcttacacttatggagctaacattttcagagatacaggttctcatagtactactaaaacttttttcctctttggactgaatacctatgattataactatacagtagtttaagtttccttgtgattagtcaaaaataccattttagtatgaagcaatgaagtctattatttgttgtcccataattgagaaacttagatacaccttttattaagagtttgtaaattctagcttagtctacacagatttttatatcaatttgtttatatttttattaatgtcatttctggaattgtgaaaatgttaatgttcgacaagcaacattaaaaatagatttgaaacatt

SEQ ID NO: 281766 - DNA, 433 bp, Homo sapiens
gactggattatcctgttagacctcagatcatagattgctagtctctgctaaggacaaatattgtagaattttatctgtacagggatattcttatacaaggcctagaaatgttgtcctgtttaaaaattagccaaaagtaacaatatataaaaagagagtaaaagctttctatttttatgtgcaggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctt

SEQ ID NO: 281767 - DNA, 299 bp, Homo sapiens
aacagagcaccttctctcactactctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggcaggagaatctgaacctgggaggtggaggttgcagtgagctgagatcacgccattgcactccagcctgagcgacaagagtgagactctgtctcaaaaaaaaaaaaaaaaaaaaaaaaa

SEQ ID NO: 281768 - DNA, 2331 bp, Homo sapiens
aacagagcaccttctctcactactctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcggtgagaggaacgctgaatcgccgaagagaattggctgcgcttccttgtttgtgagctagaattagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggactggcaacacatgcaatcaaaaggttgcttcttcttagaagaagatggtgaaatcattagtcatcagtacaggatgcaaatagctcagaggtccatggtttatctaacaattaagccattaaacctgagtcaagttgaaggaaaaccatccccttggttatccgttgatactgccttgtatattctcaaggaaaatgagagtcaagcaaatctacagcttgtgtgttttaccgaactacgaaatagagaagtgtttggatggactggtgaactaggacctggaatttactggttaattccttccacaactggctgtaggctgaggaaaaaaataaaaccagtaacagatgaagcccaacttgtatatagagatgaaacaggggaattattccttacaaaggaatttaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctt

SEQ ID NO: 281769 - DNA, 1046 bp, Homo sapiens
agactgatgattgttttatttcattgttttgagaaaaggtgtttggatggactggtgaactaggacctggaatttactggttaattccttccacaactggctgtaggctgaggaaaaaaataaaaccagtaacagatgaagcccaacttgtatatagagatgaaacaggggaattattccttacaaaggaatttaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctt

SEQ ID NO: 281770 - DNA, 2272 bp, Homo sapiens
gaaagttttcactgcatctcttgtgggatacgtataatgtttggcagatgatacttttaaatgacaataacaatagttatttttcagagagaggaatcaagatagccctgcaaattcagtgtagttgttaattctctgtattcttattaacaagattcctttattcatttatttatcaaatagttatcgagggccttatataccagacatcagtttaggtgtttaggatacattagagttaaaaaaagacaaaaatccctgccctcgtcaacttaaattttagtgagggaaacaatacataataaacataataaatagtaaatgacatggtatgtaggaaagtgataagtgttatgggaaaatcagagggaaagggggttagtgagtgctgagggaatgtgggttgccattgaaatggagtggttagtatatgcttcattaagaaggtgtcatatgaataaagactttgaaagagatgtatgagttaccaactgctacataaaaaactaccccaaaactcagtggcttaaaacaattaaacatttgttcactcatgaatcagtagatctgttagttcttagtctgagccaggcttgttttttctctatagggcttgctcacacagttatggttagctacaggttagctggtggctggctttgctaatcttggctgggttctttcttacgtatgaagtcccatctgggacaacttgactcagcctcatatgatctttaattatccttcagtaaactagcctggacctgttctcttggcacaataggatctcctgaggtttgggctcagaaccagcacaatgttacttcgttatattctgttgctcacagaaagtcacaaggcaagtccagattcataggctggggaaatagacttgatctcttgatggaaaagctgcaaagtcacattgcaaaaggctgtagatactgagggggacagccatttttgctgtcttccacagaaggcaagggagtaagccttgtgggtgtatggtgctggaagggatgggtgaagagtggaggaggtggcagagtattccaggtagacagaatactctgtgcagaggctctgtgagagtgtactggtgttaaaagaacagaggctagagtgtctcaaatggagtaagtgaggagagagttgtaggagatgaaaccagggagaaacaaggacaaaatcaggaagaggtttctttttgccataattaggacttgggcttttgatcagagaaatgaggtttccccctcgttttttcacatagatgtctggcatctcttcctcgtgtgctccaccacaggaaaaccatccccttggttatccgttgatactgccttgtatattctcaaggaaaatgagagtcaagcaaatctacagcttgtgtgttttaccgaactacgaaatagagaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctt

SEQ ID NO: 281771 - DNA, 1375 bp, Homo sapiens
aacagagcaccttctctcactactctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcggtgagaggaacgctgaatcgccgaagagaattggctgcgcttccttgtttgtgagctagaattagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggactggcaacacatgcaatcaaaaggttgcttcttcttagaagaagatggtgaaatcattagtcatcagtacaggatgcaaatagctcagaggtccatggtttatctaacaattaagccattaaacctgagtcaagttgaaggaaaaccatccccttggttatccgttgatactgccttgtatattctcaaggaaaatgagagtcaagcaaatctacagcttgtgtgttttaccgaactacgaaatagagaagtatacatatttattttctaatgtttaatttttaaatatagtatgaactgca

SEQ ID NO: 281772 - DNA, 136 bp, Homo sapiens
cagggtttattctgaggcttatatttgtctgtaattattaaagaaaggaatagcagcttatgaaatctttttttaatagtcagatgagaaagtgattattcacatcagcaatgagctaagtaaaaactgcataaac

SEQ ID NO: 281773 - DNA, 4142 bp, Homo sapiens
  misc_feature (2503)..(2503): n is a, c, g, or t
  misc_feature (3287)..(3287): n is a, c, g, or t
aacagagcaccttctctcactactctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcggtgagaggaacgctgaatcgccgaagagaattggctgcgcttccttgtttgtgagctagaattagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggactggcaacacatgcaatcaaaaggttgcttcttcttagaagaagatggtgaaatcattagtcatcagtacaggatgcaaatagctcagaggtccatggtttatctaacaattaagccattaaacctgagtcaagttgaaggaaaaccatccccttggttatccgttgatactgccttgtatattctcaaggaaaatgagagtcaagcaaatctacagcttgtgtgttttaccgaactacgaaatagagaagtgtttggatggactggtgaactaggacctggaatttactggttaattccttccacaactggctgtaggctgaggaaaaaaataaaaccagtaacagatgaagcccaacttgtatatagagatgaaacaggggaattattccttacaaaggaatttaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatgccttgaagggaaaagataaacaccagctgccagtcttttggttgtacaacaagaaggtctggacaatgagaaccctttttctagattggttccatcaatgctttgtcgctgaagtcaggaagtactttgccagtaagcgaccaccttttacagtttttttgatctggcacaatgtccctggccacacggaaccccatgattcaacactgaaggtgtcaatgaggtctacttgctccccaaaacaaggttcctaattcaacctatagattggaggtcatgagggcctttaagtctcatttcacgtgggaggtactctgtggaaaggaatgtcaacgctatggatgagaacccccaatagagagaaaccatgatatgaagccgagatggccttttagaaaagaaaactatataaaaataaaanactgaaagattaaaacaacaataacaaaaggacatcataaaagtctataaagataataccattgattatgctacagaaaaagccatgaaagtcatcaaacctgaaacaataaattcctgatggagaaaactgtgtccagatgttgtgcatcatttcacagaatttatgacagacctaatcaaagaaatgaaagacgtggatatggccaaaaaaaaaaaaaaaaaaaaagtgggaggtgaaaggttttaagatatggatcttggagaaattcaagacaccacaccagaggagttaagacaacaggagagagttgagtgattctgaaccagtgccaaatgatgtggaagaagacatagaagaagcagtgccaggaaacaaaatgacatgagacagtctggcataagggttctgattattcaagatcacttttgacttcttttgcaacatggaaactaaagcaaacagtggaagatggattgtactgtatagaaacatttttagagaaatgagaaagcaaaaaagtcagacaaaaattacagtgtagccgggtgtggtggctcatgcctatatctcagcactttgggaggctgaggtggaaggattgcttgaggacaggagttcaagatcagcctgggcaacatggtaagacattgtctctacaaaaaataaaattagctgggcatggtggcacacacctgtagtcccggctactcatgaggctgaggccagaggatcacttgagcccaggagttcgaggctgcagtgagctatgattgcaccaccncaatccagcctgggcaatggagcaagatcttgtcttgaaaaaagaaaaaaattacagtgtatttccaagttacaccaagtgtgcctgcctcttctgcttctgctactcttgagacagcaagaccaacttctcttcttccaccttctattcaacatggagataatgaggatgaagacttatgatgatccactttcacttaatgaacagtaaatatatgttctcttatggtaacaaataacattttcctttctctagctaactttattgtttatgttccataaggcttctggtcaacataggctattagtagttaagtttggggggagtcaaaagttatggatagattttccacttgtgggggtggttggcattcataacccccatattatttcagggtcaactgtacattgttgagcatttttgtgactgcataaaatggatgttggtctgtagttttcttaattggaaatgtctttgtcttgtttgggtatcagagtaattctggcctcataagatgagttgggaatgctttctcgttttctggaaaagactgtaaaattggtgttatttctttaaatgttcacttgaatttctcattagaaacatctaggcatgaagatttattttggaagaggtttttttttttttaatacaaattcaatttctttaacagctacaggatattcagtttacctattcttggttgagttttggtagtttgtagtttttgagcatttggtccattttatctaagttgtcaaatttatgtgcatagaattttttaaaattgtcaatgcagtctgtagtgatatccctttttcatttctgatattaataaaatgtgtcttctctgtt

SEQ ID NO: 281774 - DNA, 1222 bp, Homo sapiens
aacagagcaccttctctcactactctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcggtgagaggaacgctgaatcgccgaagagaattggctgcgcttccttgtttgtgagctagaattagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggtatagtattttaagttaacagatgactttttctgaaaaaaatttgacattaagtttattaataactgtgcagtgtctacagggaaccagtaaagtttatgaagtaatttgaggtttttctgtgtaatttctacctgtaagctagtgtaat

SEQ ID NO: 281775 - DNA, 866 bp, Homo sapiens
cggcgctgatttgaagattgaataccggctaccgtcctactacgcgtgtgcggaagtaactgtccacctagagttcctggactcctcccgggtgtaggccatccgtcggagaccacatttcccataaggccagtggagctcgtttccggaagacgtcagacgctgcttcctcttggggggtggtgcggagattcccggggtttcttctagcaatgcaccaggttaagtcggagaggtgaagaggatccaacaaagaagactgagaaggaataatccatgaagtagatggaaaagtaggagagtttagatctgcaaaaccaagatgtccaggatttaccagctcatgtataacatggaatcatactaacaacattcaccatgttctgttggctcttaatgttccagttaatacagaaactctacccctgccaattgccctccccatgcattgacttctgcaaattctccagtagtgtcacaagcaagtccttatcttccaggcttggaataacacgtacacaactatatatggtggtcatctttgaaggactgcagttatgaaaaaaccatcagttcaactgtcctggacagcatttcattttattatgtaactgtagaaagccttgatcaagataaaaatagggatgacttatcagaaactgaagaattttcttaggaaagcaaagtttactgaaggataccttcattccagccatgatgagcatctgtcttctcaggcaatcatgatgaagctccagggacagtataacccatctctcccactcatccctgagccttggtcctggactgaatgtggttagaggttgtggaaataaaaaaaagaaccaaaataagaacactctcca

SEQ ID NO: 281776 - DNA, 544 bp, Homo sapiens
cggcgctgatttgaagattgaataccggctaccgtcctactacgcgtgtgcggaagtaactgtccacctagagttcctggactcctcccgggtgtaggccatccgtcggagaccacatttcccataaggccagtggagctcgtttccggaagacgtcagacgctgcttcctcttggggggtggtgcggagattcccgggttggtatctctattgctagcctgagagccacgctttttaagtcgttttcatttaaaaggatacacagcatttttaaatactggaaagtaaaatcggcggtatgctaaaaacaatttgctcttactcagcagggtttcttctagcaatgcaccaggttaagtcggagaggtgaagaggatccaacaaagaagactgagaaggaataatccatgaagtagatggaaaagtaggagagtttagatctgcaaaaccaagggaaggaagtgtttcaagaagggagtgacccattgtctcaaatgttgctcataggtcaagtaaaatgagaattaagaatgggccactgta

SEQ ID NO: 281777 - DNA, 850 bp, Homo sapiens
atggggtcttgctatgttgcccaggctggtcttgaactcctgtcctcaagtgatcttcctaccttcccctcccaaagtactaagattacaggtgtgagctaccacacccagctgagaaaattatataacccttctaggcctcagttccctcactggagataatggatacagatttaattataatgtgcttagcacagtgcctggccataagagtcactcagtgaagagtcatcataagattccagggtccataagaagagtatgtgaagaagggcctccagagacaacctaccttatctcctacagatgtccaggatttaccagctcatgtataacatggaatcatactaacaacattcaccatgttctgttggctcttaatgttccagttaatacagaaactctacccctgccaattgccctccccatgcattgacttctgcaaattctccagtagtgtcacaagcaagtccttatcttccaggcttggaataacacgtacacaactatatatggtggtcatctttgaaggactgcagttatgaaaaaaccatcagttcaactgtcctggacagcatttcattttattatgtaactgtagaaagccttgatcaagataaaaatagggatgacttatcagaaactgaagaattttcttaggaaagcaaagtttactgaaggataccttcattccagccatgatgagcatctgtcttctcaggcaatcatgatgaagctccagggacagtataacccatctctcccactcatccctgagccttggtcctggactgaatgtggttagaggttgtggaaataaaaaaaagaaccaaaataagaacactctcca

SEQ ID NO: 281778 - DNA, 770 bp, Homo sapiens
tcatatgaaacagacaatcttatgaaacttaccaaggatgtttccagcaaccccttgtttagggaacagagtaaaggggagaaaaggtagcattttcaaatctcaagaaagtgttttatgtcagaattcaatttgtcccagagcacagctgtcaagagctttgtaaatctaggcctctaggaggagagggctaaagcactttcaggataaaggctagaagcctaaggccctgatcatttgggcaatccttgttattgcatttgttgttccattctctgacacttctaaaaggctgtggaatctccagatgtgttcataaaatagtggtagcaattattcattgcttctaggaaagggaaatggatatgttaccaacaaagccagtccccatacaaatggagtctttccctgtttagtgctttgaagccaatatacaaaaccaaaagtgagtgtcaagtagtgcaggctttattccatggccactgtattagtcagggttctcttagagggacagaactaataggatagatgatagatagatgatagatagagagatagatagatagagagatagacagatataaagggaatttattaagtatcaacttacatgatcacgaggtcccacaataggctgtctgcaagctgaggagcaagaagggccagtccaagtccccagactgaagaacttggagtccgatgttcaaaggcaggaagcatccagcatgggagaaagatgtaggctgtgaggctaggtccatctctccttt

SEQ ID NO: 281779 - DNA, 314 bp, Homo sapiens
ggccccagaaagtaaccacggaggtcaagatcacaaacccgtcagtgtccagggcatggcctcgcacacatccgaggttttcaaggaccatgaagtgccatggcaagcatcctggcctgagggttaggagagctggatctcaggctcaactttagcctgaattcggtgcgtcatcttagacaaatctgctcaagtcctgttccttgtttaaccagcatttattaagtacttgcagtataccagccactattttggacattagtgatatggagtgtaataaagacttaataaaggctaattgtgatcatcaaaaa

SEQ ID NO: 281780 - DNA, 416 bp, Homo sapiens
ggccccagaaagtaaccacggaggtcaagatcacaaacccgtcagtgtccagggcatggcctcgcacacatccgaggttttcaaggaccatgaagtgccatggcaagcatcctggcctgagggttaggagagctggatctcaggctcaactttagcctgaattcggtgcgtcatcttagacaaatctggtgagctctgagggctggggtaaggttgagaaactgtgggctcctcagggtggggggtgcttagagaagatggggcctctgagtcctcagactgggggtcttcatcgggttcagcatcctccccaggcccaagccctgccagcctcttgctggcctcccatagccgatgggctgcccggtcgtctcgggcagctggaggcacctcttccacatggcagttggcaaaat

SEQ ID NO: 281781 - DNA, 2474 bp, Homo sapiens
ggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281782 - DNA, 2472 bp, Homo sapiens
ctcttctctctttttttctttattagtcttgctagcggtctatcaattttgttgatcctttcaaaaaaccagatcctggattcattaattttttgacgggatttttgtgtctctatttccttcagttctgctctgattttagttatttcttgccttctgctagcttttgaatgtgtttgctcttgcttttctagttcttttaattgtgatgttagggtgtcagttttggatctttcctgcttctcttgtgggcattagtgctatagttcctctatacgcttgaatgtgtccagagattctgggtatgttgtgtctttgttctcgttggtttcggaaattctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281783 - DNA, 1989 bp, Homo sapiens
ggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagaagtcatggccagcacttcctcctttctatagcgtccagtcccatcagagaactaaggtttttttgtttttgttttttcatatgtgatatacaagcccaaactacaattgagaatcataaaatacggattgaaaaccagaaggagtaatgttactgttgaaagtggagagacaatgtatcaggatcctaaactgcttttgcatttaagcaatatatttaaccctaggcttcctgccagtccagttgcaaaggaatgtccagggattatcatttgaaaaaaagaaagcaaatggatgtctaaaaagaccctttcctagcattgaatttgtggaattgatctatctcataggtttttatgtatgtctcagtagggattgaactagagaccacattatggtgaattgaccctcacttttttttaggaggaatgtaaatatgatataccccatttccaaaagagaaaccctctattgctacaaaattaaacattcatttgctggttgtgcgttcaaaattctctggcagatttttccccaaactaccacctgtctgagtgcctcttggtctaacatcatgcatgaagaacaaccaggttcattcccattctgacctgatgaagaaagctctgcgaatctcaaggaacatagcactagcttgcccctggtgtgcaatgtctctgacatgatttggcaggactctgagagcaaactgcctaagactgtgtgctgtgcagatattcagggtcgttgtgagcatcccgttgtgaatatcaaggagcctgccccctcagctcatctcaactcctgtatgcaagggcacagcggcttcacaaaagagcctcacttttattcaagtgcgcaggtaattacttggttgaaacaatagtgtttctgtgccacagagcacaggggatcaatttttatgtgccgttgccttgactataaagtagcttttgtgtggcacttctcccactgcatcgtaatgggctcagttagatggatcagctacagagtgtatgagctccaggtaaatgaatgagtttaccagcagaacataatcctttggcattgctcatctgcgactgaagaatgttttcaaagtgattattttattcttgtcaaaaccaatatcaagtcaccctttctgacaataattaaccaacaggtttggttgcttcttaaagttgcttcttgtaaatgtcagaatatctgagtgtgagtcctaccagtcactagtgtgatttttgaaaaattacttaaatgtcctgattctcactaactgcatttatgaaataaggatatcaacatctacattacagtactgtgcaggtcaaatgacctaaagtatatgaaagttcattgtaaactgtaaaatgcaatgcaaaaaccactgttcttattattactgttattataataaagttatgttattaacacagtgca

SEQ ID NO: 281784 - DNA, 1498 bp, Homo sapiens
acggcagactaaggccagcggtgatggcttgaatgccaggctgggggctgggatttttcctgaggatttcacaggacagaggttggcttggaaagaccaaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggaggaatgtaaatatgatataccccatttccaaaagagaaaccctctattgctacaaaattaaacattcatttgctggttgtgcgttcaaaattctctggcagatttttccccaaactaccacctgtctgagtgcctcttggtctaacatcatgcatgaagaacaaccaggttcattcccattctgacctgatgaagaaagctctgcgaatctcaaggaacatagcactagcttgcccctggtgtgcaatgtctctgacatgatttggcaggactctgagagcaaactgcctaagactgtgtgctgtgcagatattcagggtcgttgtgagcatcccgttgtgaatatcaaggagcctgccccctcagctcatctcaactcctgtatgcaagggcacagcggcttcacaaaagagcctcacttttattcaagtgcgcaggtaattacttggttgaaacaatagtgtttctgtgccacagagcacaggggatcaatttttatgtgccgttgccttgactataaagtagcttttgtgtggcacttctcccactgcatcgtaatgggctcagttagatggatcagctacagagtgtatgagctccaggtaaatgaatgagtttaccagcagaacataatcctttggcattgctcatctgcgactgaagaatgttttcaaagtgattattttattcttgtcaaaaccaatatcaagtcaccctttctgacaataattaaccaacaggtttggttgcttcttaaagttgcttcttgtaaatgtcagaatatctgagtgtgagtcctaccagtcactagtgtgatttttgaaaaattacttaaatgtcctgattctcactaactgcatttatgaaataaggatatcaacatctacattacagtactgtgcaggtcaaatgacctaaagtatatgaaagttcattgtaaactgtaaaatgcaatgcaaaaaccactgttcttattattactgttattataataaagttatgttattaacacagtgca

SEQ ID NO: 281785 - DNA, 255 bp, Homo sapiens
gcgcccgccactactactactactgctcgaattcaagcttctaacgatgtacggtgacatgctttctttgagttttaaattatgtataaacataagttgcatttagaaatcaagcataaatcacttcaactgctcttctgtagttcttggatttcttttcccttttgactttgaataaatgtaaaatcctttcagccagaaaaagtaaaatagaaacaacctgtattaaaaatcttccatagaagcaaatttgcc

SEQ ID NO: 281786 - DNA, 2512 bp, Homo sapiens
  misc_feature (31)..(31): n is a, c, g, or t
tctggtcgggctcccgtgtaatcggccgagncgacgccaaggggagggggctgacctgtgcttggtccaccccaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281787 - DNA, 2419 bp, Homo sapiens
ggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctgctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281788 - DNA, 1735 bp, Homo sapiens
ggtcttttcagagacagttatcacatctgtgggagacgaagaaggcagaaggagccacgagtgcatcatcgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281789 - DNA, 2595 bp, Homo sapiens
ggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctcttctgtagttcttggatttcttttcccttttgactttgaataaatgtaaaatcctttcagccagaaaaagtaaaatagaaacaacctgtattaaaaatcttccatagaagcaaatttgcc

SEQ ID NO: 281790 - DNA, 2885 bp, Homo sapiens
  misc_feature (2885)..(2885): n is a, c, g, or t
ggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggaaaaaataccggggggggaatgcccccctttttaagaaaggggccacccaagagggagcacataacacgaacgggcggcggccgctaaacaaacgagcggggagggacaaacggacacgggacttgcggacagaccccatggctgggggcaccaaggggccccccccagaaaagagccggggacaaaacaggcggtttgcgcacccggccttgtgctgctctgctgttttatacccctctcgtactcagggagacacgcaacacgccgcacaaactgcacagacccaaaagaccagcggcagctcgacctgtcn

SEQ ID NO: 281791 - DNA, 1918 bp, Homo sapiens
ggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagaccctattctcacatccctc

SEQ ID NO: 281792 - DNA, 781 bp, Homo sapiens
agcctgagcaatactgctggatgaataaacacatgtaatgcagggtgaacagaacatttcatctgcaacagctgaaggcacagctcacctatgcccatggaaagaactgcgtggaaaattcctttgttgcatttttgccaggttgatgtttgcaaagcagggcactcttctccacatttccccaaaaccaatcagagggagactctgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281793 - DNA, 2681 bp, Homo sapiens
  misc_feature (31)..(31): n is a, c, g, or t
tctggtcgggctcccgtgtaatcggccgagncgacgccaaggggagggggctgacctgtgcttggtccaccccaggtaggggctgagagaggcttgaggtggaagtgggggtcgggcactctgacctggtcgaggaggggctagggtttgaaccggggacagagtctaggtgagctggggcttgggagctattagcgtagaggatccgggttcggttgctctggcgagggctccagcatcacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281794 - DNA, 896 bp, Homo sapiens
ggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggtgagtggcctcccctcagatgcagga

SEQ ID NO: 281795 - DNA, 2607 bp, Homo sapiens
ggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281796 - DNA, 2514 bp, Homo sapiens
  misc_feature (8)..(8): n is a, c, g, or t
  misc_feature (14)..(14): n is a, c, g, or t
  misc_feature (17)..(17): n is a, c, g, or t
  misc_feature (19)..(19): n is a, c, g, or t
  misc_feature (28)..(29): n is a, c, g, or t
  misc_feature (35)..(35): n is a, c, g, or t
  misc_feature (38)..(38): n is a, c, g, or t
  misc_feature (54)..(54): n is a, c, g, or t
  misc_feature (59)..(59): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (72)..(72): n is a, c, g, or t
  misc_feature (94)..(94): n is a, c, g, or t
ttttttgnctttantgncnttattttannttttgnacntaaagaaaaatcatgntcatntncntnatgaacnaaaacttaaaaaggcagaactngaagacacgtgtccttcaccaaagcaaatctgtgctaaaggttccaaacatttcaatttttaaaataaatattttcattttccgatgtctactttcatgtcttcagagtgtcacaggaaatcgaagcctatcatgaattacaatttttttttagagtcccggctcactgtgtttggtaacttgccataccatatccggcttggttaggaggaggtattacagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281797 - DNA, 2193 bp, Homo sapiens
  misc_feature (31)..(31): n is a, c, g, or t
  misc_feature (770)..(770): n is a, c, g, or t
tctggtcgggctcccgtgtaatcggccgagncgacgccaaggggagggggctgacctgtgcttggtccaccccaggtaggggctgagagaggcttgaggtggaagtgggggtcgggcactctgacctggtcgaggaggggctagggtttgaaccggggacagagtctaggtgagctggggcttgggagctattagcgtagaggatccgggttcggttgctctggcgagggctccagcatcacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacagtgcatcatcgacgaggactgtgggcccggctctcagctacccgcagaggaggccaccctcctntagatgttccgcgagttgaggactgatggaggacagctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281798 - DNA, 2151 bp, Homo sapiens
  misc_feature (2066)..(2066): n is a, c, g, or t
  misc_feature (2100)..(2100): n is a, c, g, or t
ggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatggcagcctccacatctcgggttcaagtgattatcctgcctcagcctccaagtagctgggattgcaggtgtgcaccaccatgcctgggataattttttgtattttttagtagacacggtttcaccatgtttggccaggctggtctnggaacttctgagtgtaaatgatctgcccaccttntgccttcccaagtgcttgggatttacaaggttttaagccacccgaatccat

SEQ ID NO: 281799 - DNA, 755 bp, Homo sapiens
tcgctattcatcggcacctcgctattcatcggcacctcgctattcatcggcggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 281800 - DNA, 1835 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctgtgagtaaggctgtccctacttcccacttacaccgaacgactttcgtcccgactctcgccccaaagctgatcttcctcagcagggatcatagtcactaccaccacctccttagctttgggtttggtttccagccagggctgttgtcttcctgaattgtcctcacctaatccagtacctccttacgctttagtcagtcaaatcttgtatttcagcctgtgatgcaaaaagttgcaagaagcagaaaaagggctgatgctgcagtctcagggcactagggcagggctggagaagacatccaccaaatctctgtggccaaacagatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281801 - DNA, 458 bp, Homo sapiens
ttatgggaggctggtggtgtggctgtcgagagctgaggaggagatggggtgagtgggatgagggttcagttaagtcaaccatggagctcactgatactttacttttccagacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281802 - DNA, 762 bp, Homo sapiens
  misc_feature (689)..(689): n is a, c, g, or t
  misc_feature (695)..(695): n is a, c, g, or t
  misc_feature (729)..(729): n is a, c, g, or t
  misc_feature (743)..(743): n is a, c, g, or t
  misc_feature (755)..(755): n is a, c, g, or t
gcagtgagggccccgccgctaccccagcagtcgcctcccaagttcgcggaacgcagctgaccggctccctctggactgggtgacatgactgctcccaagcagtcgtttgtaaactgagtttctgtaaaacaattttatttttcatatgtgactgtagcggggtatgatttgaactttgttttccgtcccccagcccggattctctgtcttctcctgtacagccgttccgttttcttacctcgtctccgtcaccgaggccctcagccctgaacacaaggactgggcagtttccctattgattcctgaacctggaacttaagacatcttccgaggggcccccccttgccacaccctctagctgatcgactcacaaatacctgtgatttctctccccgtctccacctccagacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctgtgtctcacanctccancaaaacaaaaaggttctggaaatcactaacacancctgaaggcagcanctccgcctcaanataaccc

SEQ ID NO: 281803 - DNA, 656 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgtgagtgtgcctgtgcggggcagccgcggggccaagtgctcgcgcctgtcccggctgcggatggcgctgggccccgcggggtgcagctccttccgggataaacccgggcgcagtccttccgacgcccgggctgccgtgccacattcaccttcatccggtgcgcctgaatccgacgtgcaccggccccctgcggatggtcccaattcacctacctgccccccttcccctctctccgtctgatatttccttccccttctcccaggtaacgcccccgagtcccca

SEQ ID NO: 281804 - DNA, 1883 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctgtgagtaaggctgtccctacttcccacttacaccgaacgactttcgtcccgactctcgccccaaagctgatcttcctcagcagggatcatagtcactaccaccacctccttagctttgggtttggtttccagccagggctgttgtcttcctgaattgtcctcacctaatccagtacctccttacgctttagtcagtcaaatcttgtatttcagcctgtgatgcaaaaagttgcaagaagcagaaaaagggctgatgctgcagtctcagggcactagggcagggctggagaagacatccaccaaatctctgtggccaaacagatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281805 - DNA, 1406 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281806 - DNA, 1501 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281807 - DNA, 307 bp, Homo sapiens
ccttggggccagaacagcacacagaatgactcccctccaaaggctggcagagattcttactcagctggaaggcaaatttagcagtgagcctgcatctgcagggtggcacttgatggattcagggacaagttaccaaagagctgtcatatatacagcccccttgccaaagctgaggcctccctagggtgtgcattttcttccatatttctcatcactctccatgtatctctggtctctctgaatctcccctcagcactcttactacttcttaaattcactgttgccaaatggtggttcagggaattca

SEQ ID NO: 281808 - DNA, 1562 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281809 - DNA, 608 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgtgagtgtgcctgtgcggggcagccgcggggccaagtgctcgcgcctgtcccggctgcggatggcgctgggccccgcggggtgcagctccttccgggataaacccgggcgcagtccttccgacgcccgggctgccgtgccacattcaccttcatccggtgcgcctgaatccgacgtgcaccggccccctgcggatggtcccaattcacctacctgccccccttcccctctctccgtctgatatttccttccccttctcccaggtaacgcccccgagtcccca

SEQ ID NO: 281810 - DNA, 1514 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281811 - DNA, 1315 bp, Homo sapiens
gaggacgtgatgaccgaagagagtggggcagagctgctcagacatggtgagcatcactatgcagatctgagcgtcagtcggacagcactgcgtctgagagcgtgacgtcccagctgtcggcgatttcgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaa

SEQ ID NO: 281812 - DNA, 1236 bp, Homo sapiens
gtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttggtaagagtgagggatggggctg

SEQ ID NO: 281813 - DNA, 2408 bp, Homo sapiens
gaataaattagaggggatctcggtgcgaactttccttgacctcgaccccaaagaggcttgctggggccgagaagaaaacccgtgcgggatgtggaggggcccggggcgccggggtcccccgcccgcgagacccgctccaccaggcgccttggagagcagcgccagcggtcgtcctccagctcccgcaggggtcgccccgccggcgcgagggacacaatgggtccgcgggccacgcgaacgggcctcggcccggcggcagcacgggagagatgtgaggagcgcgcggaaggggagcgcggccggggagatcccagcgcggtcaggcccgggagccgaggctcgggggcccgggaactgggcttcccacagcagaagacccaacaaagacaccaggggagcccggcgggctgggcgcgagaagacgtggtagcaggttcgctcctccgagcagacgggaggcgccatcatggggggggggggtcgcggcccgccccgcgcagaaagagcccccttcccgccgctgcccgcgcccccagcccagcacgaccgcggcggccccacgcgtgcagagacggcggcggcggcgctggaaagcccggggcgccgaggggagggctgggacgcggcatgaagggaaagttcggttcgggtctgtttcgttttaccgggttggcggcgcgcccgtccgtgcgggagcacgagtggccgggcgagcggggtctcgcggcccgggtccggacggccgggcgctgcgccactctccgctccccgagcctcggcccgggttgagccgctcggcctctcctttctccgcccgcccgcctgctttctcctggagcctggattgatctggtcgcgctggcgtcagggagtcggagctgcccagcctccactcctcagctgccaatacccggcgcactcgcctgcctgcccgcccgctcacacgctcacccgctcacccgcgcgccgccgccgctgccgcgcgaccagggatcctctccaaattcccggcccggccggcgtgagcgcagcgcggccggggccggaggacggcgcgggggagcggccggagccacccccttctaccggcagccccacgccccgtttcttcctggagaaaagacagtgtggcggcgttcaggctttcctaaccctgcctttttagtcccggtggagcggacttagtccattatctgcaagtgaatttcgatgttccatatgtttattttctgaaatgttcattaacgcttccaccgcgcccactgaatcgttctataaacgtggagtgcatgttgacagttacctttcgagacgcgcccttttatgtctatctttcgttgcccctcactcactctccaataatttgcaggccccagaagttgtacgtacccagaattggatagcctagtaaatactgcacgtggttatacaaaccctgagtcaacagatgcgttttgtgtcaactcaggatccagtgattcgagtaggtaaccttgttgctccaaataatggcatgccataaggagatactgctttagaactccacatttttggtccaatttctacagtcttttagatgatgccaactcccccgcacttaactcttacctacctgatctgcatagacattgaaaatatcttcttgcaagagtcaacttttctcttggctaactcttgaagctgcataaaatcttgcataattactataatgttgagttacgtttagaaaaaatgatttttttttgaggaataaatttcacatgaagcaaaaaaaaaaaaaaaaaaatcactcccagcaatgtatatcagaatatgtcttctaattaaattcctttttcccttaacctatttgagcacttactggtcaattcgtgggcctcatcttattttccctaaaagcagcgtttgacgcagttgatcattctctgctccttagaacaacaggaaagtgaaccttgttaaatgccactcggatcaggccactcctctgttgaaaaccctcccttgataaatagtataaagtatcccatacaagagaacattattcagccataaaaaggaatgaagtactgatactgatgcatgctacatggataacctttcaaaacgtgaagggaaagaagacagaccacacattgtattcttccacatatgtgaaatgctcagagtaggcaaggctatggagacagaaagtagattggtggtttgcatagggttggggaaatgaggaacctggggagtgacagctaaaggttatggggtgacaaaattgttctaaaactagtttctggtgatggttgcacaactctgtgcatataccaaaagccattaaattgcacactttaaatgggtcaatcatttggtatgtgaattttacctcaagctattaaaaaaaaagcatgacaatg

SEQ ID NO: 281814 - DNA, 415 bp, Homo sapiens
aaattacaaaagccttttgcttcaaatccctacctcccatgtttattgctccacggggacccatatcacccattctcatttcctgttctctctgtaagtaaacatagttgtcacagtcaacctatcgatcttatgactttacatttcccatctaaaatcaaaaagaaaagagtgaattgggacatcatttttcattaaaaattttgaaaagtttccatcatcataaacttaataagaatgctgaaaagaaacttcagtctcccaggcttaatatactacaaatgcttaatgcatccagtttatattgcaagattagattactaatgaatcagattatataaaatatatcacaaattatttttaatgtttttattccaacagatgaaagacacatgcctagattccaagcaaagga

SEQ ID NO: 281815 - DNA, 3706 bp, Homo sapiens
caaaatattatccattgtaaactgagatttaattctcaaatgtattctacttgttctaaaacaatctgtccacaaatataagactataagtaataaattgttatttccgcacaatgggaatctctaatgtgaaaatgtattctatgaaaataatttttttaaataaaatgttgtataaaaaaaaaaaaaaaaagatgaactgtccctgcatcggcctaaaggtatcagtgctcaaaatcccactcctgctttccaactcaaaggcttgactcttgcagttcatctctcttctgtatcatcagatttttcctctctatcggattattgccctcctgcttctcctccatttctctgttcccctttatagcaaagtccttggcagagctgcccctgcatgctgtctccactttctcatctcctgctcttgaatcagtcaagccaggctgttgccttcttcctcctctacaaccatgcatgccaaggtctcctggccaaatccaatggctacttcccagccctcatccgacttgacctctcagcagcattcagcccacctggggccctctctttccttgccttccaggacctcatgctctcctgggcttcctcctgcctctccaagcacaattctgtctcctttgctggctcttacacatgtcccccctctaaaatgcagggtgttctaggactcagtcctcagacttcttcccatctctctttatcctcactcctgagtgatctccttgggtctcatggctttaaacaccatctgtattgtaacaactcccaaatttatatccctagccctaacctttccactaagcttcagacttgtacatctccattcagtgtctccactgggatgtttcatacacatctctaccccccctcccccaaccttaaccctaacgctaccacattcgacactgaactctgggttttccctcccagatctatcccaccccaacattccccatctcagtaaatggcaccagcagccgctgagttgtgccagatgagaaccttgaagtcatcttgaccctctcccaccccacgtgcagtctatcagcaaatcctgtcaattctgctattaaaatacagtcaggatccaaccacttcccatcactctcacagctattgtcctagtctgagtctggatgatggcaatcactgccgctctggtctccacctgcttcctctcttgccccttcagtcttttctgaacccagaagccagagtatcttaaaacataagtcagatcatggctctcctctgcccaacactccctagttctccctgtatttctcagagtaaaatccaaagtcctttgggacactgaggcacagtaaaggggcttcatgcttttttttgtaaacatgcatcatctcatgtgattaattcaattactccctcaaaaccctatgtggtagtactgctaccctcatattacagatgaagaaactaaagctctaagaggttaaattgcccagagtcacacagggatttatggcagagctgggatgcaaaccccagcctttgactccaagtccagtgcactttcttctaagccaggctggaactgtgggttctcgcttgggttctgccactatcttgctatgtgatcttgggcagtcccttcccctctccaggcatcagctttctcacctatgagatgggaaggttggctatgtcctcactcagggtcagggttacatcagaggatctgggagagccatttggattggccttaccttcacagctgccttcaaatttagactttcgacaggctctcccaatgagaggacatatgcagttactaacacgcactgactgaaagaagatgctggctgtacaaacttgctggacccactgctggtgaggctctgagaattaattacttttatataaccataattatatcatgaatagcacaatcctacaggattatactgtagtagttaaaggcattggtttgttgtgtttaaacatttgcacagaccacatttttgtaaactcatttggatatctatctatctatcaatcttttcttttcttttttctttattttaaatttgagatgaagtcttgctcttgtcccccaggctgcagtgcaatggcgcgatctcggttcactgcaacctccacctctcgggttcaagcgattctcttgcctcagcctcctgagtagctgggattacaggcgcctgccaccatgcccagctaaattttgtatttttagtagagatgaggttcccccatgttgaccaggctggtcttgaactcctgacctcaggtgatctgccctccttggcctcccaaagtgctgggattacaggtgtgagccactgtacccagcctgtctgtctgtctatctgtctgtctatctatctatctgtctatccacctacctatttatttagagatgaggtcttgctatgttgcccagctcggtccctaactcctgggctcaaacaatccttccaactcacacctcagcctcctgagtaactgagactacaggtgcatgccaccacaactggataatttagaaaaaattactttttagagatgaggatcttgctatgatgcccaggctggtctcaaactcctggcctcaagtgatcttccttcctcagcctcccaagtagctgggattacaggttgtctttatttttcaaaaccctggaaaccccaccaaatggagcttttggcccttttctcccaggtccctcctcccagcaccatgactcacgttgaagatattactgatgaccatcctcaggttgcctaaagctgtcacctccaccagcaccatcaccaccaactgcgccaagttgaccttccccaagacagcttccactgagatcagcaccgacaaagcactcatggtggccagccgaatactgggggagagagggagagccaggacgactgagaaggaaggatgcctctcactcattcattcattcattcattcattcattcattctttcaacaaacactgttgggcacctactttctgtgggaatagaagacaagatttctacccacctgggcgctgatgctgcagagtggagtgaccatctcttctcccgttaaggtggcctctgcaccctgagccatgtggtctggcagatgacttaaccactctgtgcctcagtgccttcatctatgaggcattgatctacacacactcatctgactgagggtgatcggggtgactgttccctcaggggatctgataactgggattctgcccagtcttcttttctgctgccatcattcggatgctcaacagagggcactcttcccccgcaggcctgcccacatccagtcaccccatccccatctggggccactgtcccttctctccgtctccgtggcagtggaaagaaactggatttggaatcaggacaagcccggcttccagtcccagccttgccactggagtggctatttcatctcactgagcctatttctccttctgcaaattaagaatgatgatcaaacgtatcccatgttggtgtcctggggatgtgaaggagttttcttcctatcggtgtgtctagcaccaagactggcacaaagaaccaacttctgaaaagacgctagccttattaacgctattatgattccttccttcctttgaccaatgagcatgctcaggagtagaaaattattttggtcttgaagatacttatgatcc

SEQ ID NO: 281816 - DNA, 2453 bp, Homo sapiens
cacgcagcaggatggcaagggctccgcttggggtcctgctcctcttggggcttctcggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactgaatgaaaaagaggagactctcaccactagcgtctggattggaatcgattggcaggattaccgactcaactacagcaaggacgactttgggggtatagaaaccctgcgagtcccttcagaactcgtgtggctgccagagattgtgctggaaaacaatattgatggccagttcggagtggcctacgacgccaacgtgctcgtctacgagggcggctccgtgacgtggctgcctccggccatctaccgcagcgtctgcgcagtggaggtcacctacttccccttcgattggcagaactgttcgcttattttccgctctcagacgtacaatgccgaagaggtggagttcacttttgccgtagacaacgacggcaagaccatcaacaagatcgacatcgacacagaggcctatactgagaacggcgagtgggccatcgacttctgcccgggggtgatccgccgccaccacggtggcgccaccgacggcccaggggagactgacgtcatctactcgctcatcatccgccggaagccgctcttctacgtcattaacatcatcgtgccctgtgtgctcatctcgggcctggtgctgctcgcctacttcctgccggcgcaggccggcggccagaaatgcacggtctccatcaacgtcctgctcgcccagaccgtcttcttgttcctcattgcccagaaaatcccagagacttctctgagcgtgccgctcctgggcaggttccttattttcgtcatggtggtcgccacgctcattgtcatgaattgcgtcatcgtgctcaacgtgtcccagcggacgcccaccacccacgccatgtccccgcggctgcgccacgttctcctggagctgctgccgcgcctcctgggctccccgccgccgcccgaggccccccgggccgcctcgcccccaaggcgggcgtcgtcggtgggcttattgctccgcgcggaggagctgatactgaaaaagccacggagcgagctcgtgtttgaggggcagaggcaccggcaggggacctggacggctgccttctgccagagcctgggcgccgccgcccccgaggtccgctgctgtgtggatgccgtgaacttcgtggccgagagcacgagagatcaggaggccaccggcgaggaagtgtccgactgggtgcgcatggggaatgcccttgacaacatctgcttctgggccgctctggtgctcttcagcgtgggctccagcctcatcttcctcggggcctacttcaaccgagtgcctgatctcccctacgcgccgtgtatccagccttagctcgcaccgacttcaatttcccacccatctccagtaggaaattgattttgaaaaagtaggctgccgccaccacggcattatgatcccttccccctgctgatcaatctgcagtttgtgaacttcacaagaatggtgtgtgcccgttccctggcgtgtgtaggcctggccgcagtccaggggtcagcaggaggaaagggttcacataggctctcaggtgccagtcttccagaaagcaaggactgcccttcattcagccttgctgacctcccagcctttctaaggctcagccccacgggactctggtggctgccagcttgtgagctatctatctatattcatttcatagccaaacaggagacccctttgcaggacttgcacacagggaggctgtagccaggaaaccctcttcttccctggtctggctctgctggagcgggtgggaaccaaacaccttcagtgctggtggccctcaggcccacaggtttaaggctgaggctgccctgacccttccacagtcatttcttctaggttttcttggcccagcactgcccatcccaccccatgaggctcactcattgcagatcccagcccaccctgcccctttcttccccaccctggaggctctctctgcctagtctacagtactgacagaaagcaaggacatgcggcctgcatggtgggagctggttgaattgtctttattaacaaacaggatatccaaggccactacattgaggaggggggaggggggagggaggagaagggttacttgctgctcacactatatacagatgcaagcaaggggcgtggagagtgagggctccctgctccctccctccaccggggaagggcatgggctagaagaggagaggggggtcgggaatggggggaatgttttggctgcggggtcccccctccattccctggagtttgggggaaggggaatcattaaagtgctttcaga

SEQ ID NO: 281817 - DNA, 565 bp, Homo sapiens
caagattgagacttagacacagtatttcgttcccaggcacagcataattggtttaggagacagatactgatagtacacagcctcagaggcctgtgaggacccaggggaggcagaggggagagaggtgctccagcctcttcattgccaatgacccttccttcttgaccccatcgcaggcaggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactggtaagctacccccaccctcatcttaagccaaaaatcccacttctggccccaaccgctgagctctgtcctaaagctcacttctggccctgaaatctcacttcaatcatccccatctcccatctgcagaatgaaaaagaggagactctcaccactagcgtctggattggaatcgtgagtcaaatctggggaatggtgtgaggtcttgtccagggcaccccttttcccccaaacccctcccaggcagcg

SEQ ID NO: 281818 - DNA, 317 bp, Homo sapiens
caagattgagacttagacacagtatttcgttcccaggcacagcataattggtttaggagacagatactgatagtacacagcctcagaggcctgtgaggacccaggggaggcagaggggagagaggtgctccagcctcttcattgccaatgacccttccttcttgaccccatcgcaggcagccagagaccccgggaaaagctctggctgtctcgccccgccctgggctttattcggacgctgggtggggctggtacggggatggagtccctggtccgccgtcctcctcactgctgctggacgtcacctggaggtctcc

SEQ ID NO: 281819 - DNA, 2702 bp, Homo sapiens
caagattgagacttagacacagtatttcgttcccaggcacagcataattggtttaggagacagatactgatagtacacagcctcagaggcctgtgaggacccaggggaggcagaggggagagaggtgctccagcctcttcattgccaatgacccttccttcttgaccccatcgcaggcaggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactggtaagctacccccaccctcatcttaagccaaaaatcccacttctggccccaaccgctgagctctgtcctaaagctcacttctggccctgaaatctcacttcaatcatccccatctcccatctgcagaatgaaaaagaggagactctcaccactagcgtctggattggaatcgattggcaggattaccgactcaactacagcaaggacgactttgggggtatagaaaccctgcgagtcccttcagaactcgtgtggctgccagagattgtgctggaaaacaatattgatggccagttcggagtggcctacgacgccaacgtgctcgtctacgagggcggctccgtgacgtggctgcctccggccatctaccgcagcgtctgcgcagtggaggtcacctacttccccttcgattggcagaactgttcgcttattttccgctctcagacgtacaatgccgaagaggtggagttcacttttgccgtagacaacgacggcaagaccatcaacaagatcgacatcgacacagaggcctatactgagaacggcgagtgggccatcgacttctgcccgggggtgatccgccgccaccacggtggcgccaccgacggcccaggggagactgacgtcatctactcgctcatcatccgccggaagccgctcttctacgtcattaacatcatcgtgccctgtgtgctcatctcgggcctggtgctgctcgcctacttcctgccggcgcaggccggcggccagaaatgcacggtctccatcaacgtcctgctcgcccagaccgtcttcttgttcctcattgcccagaaaatcccagagacttctctgagcgtgccgctcctgggcaggttccttattttcgtcatggtggtcgccacgctcattgtcatgaattgcgtcatcgtgctcaacgtgtcccagcggacgcccaccacccacgccatgtccccgcggctgcgccacgttctcctggagctgctgccgcgcctcctgggctccccgccgccgcccgaggccccccgggccgcctcgcccccaaggcgggcgtcgtcggtgggcttattgctccgcgcggaggagctgatactgaaaaagccacggagcgagctcgtgtttgaggggcagaggcaccggcaggggacctggacggctgccttctgccagagcctgggcgccgccgcccccgaggtccgctgctgtgtggatgccgtgaacttcgtggccgagagcacgagagatcaggaggccaccggcgaggaagtgtccgactgggtgcgcatggggaatgcccttgacaacatctgcttctgggccgctctggtgctcttcagcgtgggctccagcctcatcttcctcggggcctacttcaaccgagtgcctgatctcccctacgcgccgtgtatccagccttagctcgcaccgacttcaatttcccacccatctccagtaggaaattgattttgaaaaagtaggctgccgccaccacggcattatgatcccttccccctgctgatcaatctgcagtttgtgaacttcacaagaatggtgtgtgcccgttccctggcgtgtgtaggcctggccgcagtccaggggtcagcaggaggaaagggttcacataggctctcaggtgccagtcttccagaaagcaaggactgcccttcattcagccttgctgacctcccagcctttctaaggctcagccccacgggactctggtggctgccagcttgtgagctatctatctatattcatttcatagccaaacaggagacccctttgcaggacttgcacacagggaggctgtagccaggaaaccctcttcttccctggtctggctctgctggagcgggtgggaaccaaacaccttcagtgctggtggccctcaggcccacaggtttaaggctgaggctgccctgacccttccacagtcatttcttctaggttttcttggcccagcactgcccatcccaccccatgaggctcactcattgcagatcccagcccaccctgcccctttcttccccaccctggaggctctctctgcctagtctacagtactgacagaaagcaaggacatgcggcctgcatggtgggagctggttgaattgtctttattaacaaacaggatatccaaggccactacattgaggaggggggaggggggagggaggagaagggttacttgctgctcacactatatacagatgcaagcaaggggcgtggagagtgagggctccctgctccctccctccaccggggaagggcatgggctagaagaggagaggggggtcgggaatggggggaatgttttggctgcggggtcccccctccattccctggagtttgggggaaggggaatcattaaagtgctttcaga

SEQ ID NO: 281820 - DNA, 353 bp, Homo sapiens
tcgtgtggctgccagagattgtgctggaaaacaagtgagaaccgggccagacgccaggctggagggaagccggcctggggtgcgggctggacttggttggggaagggggtactctgagagggtgcagacctgtgcaaaaagctcggtttccccgagcccacagtattgatggccagttcggagtggcctacgacgccaacgtgctcgtctacgagggcggctccgtgacgtggctgcctccggccatctaccgcagcgtctgcgcagtggaggtcacctacttccccttcgattggcagaactgttcgcttattttccggtgggaagagctactccgaggcccggacgattat

SEQ ID NO: 281821 - DNA, 405 bp, Homo sapiens
tagcttgggtgaaggagtgagggtgtccaggttgagtgagggtgtccaggatgaggagtgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccgggtgagtggcgggaagcctggcaggtgctgttgacttgggttctgtctccagattgtcagtcccctgagggcagtggccccaccctctacacctctgtctcctcagcccctagagctgtcctgggtgcccagcaggctgcagcatccatcgtcactcccctccaaatgatgcgggtatcttagatgca

SEQ ID NO: 281822 - DNA, 1795 bp, Homo sapiens
ccctcctccttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacacca

SEQ ID NO: 281823 - DNA, 1282 bp, Homo sapiens
ccctcctccttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtggtcaagaaaacaactacacctgaaggggaggtgttccatcaccaactgacattcctgtg

SEQ ID NO: 281824 - DNA, 1109 bp, Homo sapiens
tagactctagcaggatcctttacctaaatggctgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgtaaaaaa

SEQ ID NO: 281825 - DNA, 2395 bp, Homo sapiens
ccctcctccttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgtaaaaaa

SEQ ID NO: 281826 - DNA, 458 bp, Homo sapiens
gctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtaagaatgtagtgggatgaggcaggggttgaaaacagtagagaaaaaatgtcaaaatgccctttctcttatcattctgttatttaattgaaagtgaaataaagggtttgttttagaatctt

SEQ ID NO: 281827 - DNA, 1060 bp, Homo sapiens
tgctgcttctcctcctcgagctgggccacggcctgctcactgcgctgcagcttctgctgtgtccccgccagctcctcacgcagccactggttctcctgcaccagacgccgcacctgcgcccgcagcttctgcttctctgattctacagcccccaggtggctcgacaatgccaagatcacctgtgcaaccagcccaggtcttgctggacctacctccagaacatccagaactggtcccttttctccaccgtcatagccaccccttaattccaagcaccagctctcatttgaattccagcagtggcttcctaaccactcattggagagtgattccatcctcgacccactgaggtttattctccacatctcagccagagagagtttttagaaactcaagtcagactgtgttgcctgcctgcttaaagccctccagaggctttctgatttcctgagaataaaacccaaaccaaccaggccatgatctggttcttggcttctccccaggcctcttctgtccctgtctcccttccatgaagctccagtcacacagttcttccctgagttcctccaccacaagctctttcctaccccaggacctttgcacatgcaacttctcccctgcctccctttcctggaggctggttcatttcttccctcaggtttcagtttgtcatttcctcacagaagtcctgcctgaccagtagacaagactcgctgctgcgagctatcataaaatcttgttcttttctctgcagaactcatcacaatttgtaacaaccaattatttctgtatgtgtgtttttgtctctaatagggcaggaatcttgtctattttgttgggccctgtatccacctaacaccctggctggccctcaataactcatctgttaacgagtgaatagaagaattaattggtgggaggctatgtttccttaaggattttctttctgttctcatatgccatccagtctcccttaggtagaggggagccggaaatggggctctgcgtgggggcaagggtgatcatggtctcttagggcagggctggggtcgccaaagtg

SEQ ID NO: 281828 - DNA, 322 bp, Homo sapiens
atgctgccttcctctctctctcccttattccacccccaggtcttgctggacctacctccagaacatccagaactggtcccttttctccaccgtcatagccaccccttaattccaagcaccagctctcatttgaattccagcagtggcttcctaaccactcattggagagtgattccatcctcgacccactgaggtttattctccacatctcagccagagagagtttttagaaactcaagtcagactgtgttgcctgcctgcttaaagccctccagaggctttctgatttcctgagaataaaacccaaaccaaccaggccatg

SEQ ID NO: 281829 - DNA, 1213 bp, Homo sapiens
tgctgcttctcctcctcgagctgggccacggcctgctcactgcgctgcagcttctgctgtgtccccgccagctcctcacgcagccactggttctcctgcaccagacgccgcacctgcgcccgcagcttctgcttctctgattctacagcccccaggtggctcgacaatgccaagatcacctgtgcaaccagcccagcctctgctgccacagccagtaggttactgctccctgcctcagggctagcgcttgcccacagaactctgctagatggctgaaggaccacccaaagactccatccccacttctgctgaggggccacagcatcccctgcctttctgcagctcccaggtcttgctggacctacctccagaacatccagaactggtcccttttctccaccgtcatagccaccccttaattccaagcaccagctctcatttgaattccagcagtggcttcctaaccactcattggagagtgattccatcctcgacccactgaggtttattctccacatctcagccagagagagtttttagaaactcaagtcagactgtgttgcctgcctgcttaaagccctccagaggctttctgatttcctgagaataaaacccaaaccaaccaggccatgatctggttcttggcttctccccaggcctcttctgtccctgtctcccttccatgaagctccagtcacacagttcttccctgagttcctccaccacaagctctttcctaccccaggacctttgcacatgcaacttctcccctgcctccctttcctggaggctggttcatttcttccctcaggtttcagtttgtcatttcctcacagaagtcctgcctgaccagtagacaagactcgctgctgcgagctatcataaaatcttgttcttttctctgcagaactcatcacaatttgtaacaaccaattatttctgtatgtgtgtttttgtctctaatagggcaggaatcttgtctattttgttgggccctgtatccacctaacaccctggctggccctcaataactcatctgttaacgagtgaatagaagaattaattggtgggaggctatgtttccttaaggattttctttctgttctcatatgccatccagtctcccttaggtagaggggagccggaaatggggctctgcgtgggggcaagggtgatcatggtctcttagggcagggctggggtcgccaaagtg

SEQ ID NO: 281830 - DNA, 961 bp, Homo sapiens
ctgacatatacatacatacagtggaatattattcagcttccaaaaggaagaaaattctgacatatgctgtgacatggatgcaccttgagtacattatgctaggtgaaataagccagtcacaaaaacaaatactgcatgattccatttaaatgaggggcctagaatatcaacttcatagacagaagttagaatggtggttgccaggggctgggaggagggggtaggggttaggttttaataaatatcatttcagttttacaagatgaagagagttttgcagatgggttgtgggcataattgtacaacattatcaatgtatttaataccactgaattgtacacttaaaatggttaagatggtaaattttatgtgtgttttaacacaataaaaactgaaaaaagggatatatgttaccctaaataaaaaattcgtatgctgaactcagaacccccagtacctaagaacatgaccttatttggaaatgggattgttgttaatgtaattagttaagatgaggtcatgctgtaatagggtgggccccctaatccaatatgatttgtgtctttataaaaaagggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttggtggtccaagttgatgtcttaaaaaaaattc

SEQ ID NO: 281831 - DNA, 830 bp, Homo sapiens
tcctcccactgagatgacccatagtaccccattccttgctgcaatgtaattatatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcaggtaaagtccatccgtgccttgcctcccaccggcgccttccccggcctctggtttttgtccccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagacgcctcctcgattaaatgctgttttccatgaccgtctctgttcttcccatacgcgaatggcaggcatccagatctccaagaatagaggattaggagagactccaccacctatgtcctcacagttaattatcgatttgtgtcagttgcccattttctcacttcctgtttgtgtgtcaaggagtattaataaatctttgcctatttaaagatactagc

SEQ ID NO: 281832 - DNA, 886 bp, Homo sapiens
gtataacagtttctctctaactcctcccactgagatgacccatagtaccccattccttgctgcaatgtaattacaagtgtgctcctggtggtctttaactgaagggcactgactgggtactggtgaagttccccgcaggaactgagtcagaccccatctcagggccctgcagaagataggtgcctgctctaaggcgtggaccctcgcgacagccctggcccgtcttgacgggcgagggttactgtacttgtcccaaccgtacagatgagaaagctcagactcagggccagcaaccccggtcccagcggagcgcccggcacgcgccgacacttcagcaccagtcgcggtggccaccactgtgcgcggagatggctgcgacgcgtgcgcaggtaaagtccatccgtgccttgcctcccaccggcgccttccaccgcctctggttttgtccccgccagcggctccgactccatcgcgtcctcttccagtctagtgcttttttccagatctcgatcccaaactccctcctgccagaatctggacccgaatccacccattgcccattttccgctgccgctggagagaatctctgaggtccccaggacagcctgcctgcacggaagagatgcctcctcagtatggccgcccccggagaggagcgattaagtgcagacctccatgttgctcttgagcctgagcggcttcagggagccatgtttgttactggcgggcgccggcctcactgagcatgtgcagccctggccgggcggcctcaaagttctgacatcacagggcggttcctgaagtggacgtagttgtaagagctagttattttagacaatgcctctgggatcagggactctaatctggaaataggtagtgggagagg

SEQ ID NO: 281833 - DNA, 927 bp, Homo sapiens
tcctcccactgagatgacccatagtaccccattccttgctgcaatgtaattatatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcagatagctgggagagaggatttttcatgttaccaacacaaagaaatgataaaggtgaaatggccaccagacccaggctttctggaatgcattcattttctgcagttgaagggacgatcccggatctgaaagaaagagccacagtgactccaagagtggagccagggcatgctggacactgcatagctatggccacgtgtgtcacctccgagggagatgtgagagaaacacagagggatcgcttgtgactgtgccttctcgatgtatgatggactgttctgctcaaatagtaagtgtgaacaaggagccggtgaacataggaaacaaagaatatttcatttgacattataaggaatgagacaattctagtcacttgaaagtgaactatatctgtcgagaattcctagttttaattgcgaagaaatgtgcttctctttttgaaaagccacaggttattgcttttatatctaatatcagtcctctctggatctctcaaaggattttgtgtatatcctaccattttccttctgttgctgcagtttggaagtagt

SEQ ID NO: 281834 - DNA, 333 bp, Homo sapiens
  misc_feature (24)..(24): n is a, c, g, or t
ttatctggaacgactctcttaatnctccaccgctacagcggaaatttgaggggatatgccatatgaagatgaaggcagaattctacaagcccagggatgccaaagattgccagcaaaccaccagaagctatagattcttcctcacagccctcagaaggaaccagccctgccaagaacttgatctcagacttctagtctccagaactgtgagacaagtcagccatatggtttgtggcactttgttatggcagccctaggagatgaagacaatatgcaacatggtatgtccattataggacactgtgttctttggcctgaagaaataaaaccaga

SEQ ID NO: 281835 - DNA, 2038 bp, Homo sapiens
tcctcccactgagatgacccatagtaccccattccttgctgcaatgtaattatatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcagatctcgatcccaaactccctcctgccagaatctggacccgaatccacccattgcccgttttctgctgccgctggagagaatctctgaggtccccaggagagcctgcctgcacggaagagacgcctcctcgattaaatgctgttttccatgaccgtctctgttcttcccatacgcgaatggcaggcattcagatctccaagaatagaggattaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaatcgggccaggcacgatggctcatgcatgtaatcccagcactttgggaggccaaggcaggcagatcacaaggtcatgagatcgagaccatcctggccaacatagtgaaacccgtctccaataaaaa

SEQ ID NO: 281836 - DNA, 2877 bp, Homo sapiens
tcctcccactgagatgacccatagtaccccattccttgctgcaatgtaattatatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcaggtaaagtccatccgtgccttgcctcccaccggcgccttccccggcctctggtttttgtccccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagacgcctcctcggtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacgtagttgtaagagctagttattttagacaatgcctctgtgatcagggactctaatctggaaataggtagtcggagaggtcggtgatgcagtctctggatcagagacctgagctatatggggttagagaggggccctgggcaggcgagtctctggggagtgtgatgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgtttttcgcctctcattatttaaataatttgaagttttccccaataactagtgtcttagaagtcatgaaaatttcagaaaatgacaggtcttctgagttcgtgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgcgaatggcaggcattcagatctccaagaatagaggattaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaatcgggccaggcacgatggctcatgcatgtaatcccagcactttgggaggccaaggcaggcagatcacaaggtcatgagatcgagaccatcctggccaacatagtgaaacccgtctccaataaaaa

SEQ ID NO: 281837 - DNA, 2923 bp, Homo sapiens
  misc_feature (8)..(8): n is a, c, g, or t
  misc_feature (77)..(77): n is a, c, g, or t
tttttttnaatgttagaattcttttttatttcctggaagctgagatacaaaaatggaaccaaaattcagtgatgtanatctttatcatatcttgcgtggtcctctttgtgcatcacagcagggtccatctgctctgggtccttatgacatgacactattctcagtgtcctggtatgttcccgacactgtacaatggctccaatcagccctactccgtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcaggtaaagtccatccgtgccttgcctcccaccggcgccttccccggcctctggtttttgtccccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagacgcctcctcggtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacgtagttgtaagagctagttattttagacaatgcctctgtgatcagggactctaatctggaaataggtagtcggagaggtcggtgatgcagtctctggatcagagacctgagctatatggggttagagaggggccctgggcaggcgagtctctggggagtgtgatgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgtttttcgcctctcattatttaaataatttgaagttttccccaataactagtgtcttagaagtcatgaaaatttcagaaaatgacaggtcttctgagttcgtgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgcgaatggcaggcattcagatctccaagaatagaggattaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaatcgggccaggcacgatggctcatgcatgtaatcccagcactttgggaggccaaggcaggcagatcacaaggtcatgagatcgagaccatcctggccaacatagtgaaacccgtctccaataaaaa

SEQ ID NO: 281838 - DNA, 1223 bp, Homo sapiens
ttttttttaagaaactgaagcctctacttcggtctcttggtagccttcctcctgggaagctctttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaatcgggccaggcacgatggctcatgcatgtaatcccagcactttgggaggccaaggcaggcagatcacaaggtcatgagatcgagaccatcctggccaacatagtgaaacccgtctccaataaaaa

SEQ ID NO: 281839 - DNA, 1066 bp, Homo sapiens
  misc_feature (8)..(8): n is a, c, g, or t
  misc_feature (77)..(77): n is a, c, g, or t
tttttttnaatgttagaattcttttttatttcctggaagctgagatacaaaaatggaaccaaaattcagtgatgtanatctttatcatatcttgcgtggtcctctttgtgcatcacagcagggtccatctgctctgggtccttatgacatgacactattctcagtgtcctggtatgttcccgacactgtacaatggctccaatcagccctactccaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcagatctcgatcccaaactccctcctgccagaatctggacccgaatccacccattgcccgttttctgctgccgctggagagaatctctgaggtccccaggagagcctgcctgcacggaagagacgcctcctcgggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttgatgcggccggaaaccatccaatataatatactaataccatcaaacacaaa

SEQ ID NO: 281840 - DNA, 1009 bp, Homo sapiens
tcctcccactgagatgacccatagtaccccattccttgctgcaatgtaattatatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcaggtaaagtccatccgtgccttgcctcccaccggcgccttccccggcctctggtttttgtccccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagacgcctcctcgggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaatcgggccaggcacgatggctcatgcatgtaatcccagcactttgggaggccaaggcaggcagatcacaaggtcatgagatcgagaccatcctggccaacatagtgaaacccgtctccaataaaaa

SEQ ID NO: 281841 - DNA, 1038 bp, Homo sapiens
gtataacagtttctctctaactcctcccactgagatgacccatagtaccccattccttgctgcaatgtaattacaagtgtgctcctggtggtctttaactgaagggcactgactgggtactggtgaagttccccgcaggaactgagtcagaccccatctcagggccctgcagaagataggtgcctgctctaaggcgtggaccctcgcgacagccctggcccgtcttgacgggcgagggttactgtacttgtcccaaccgtacagatgagaaagctcagactcagggccagcaaccccggtcccagcggagcgcccggcacgcgccgacacttcagcaccagtcgcggtggccaccactgtgcgcggagatggctgcgacgcgtgcgcaggtaaagtccatccgtgccttgcctcccaccggcgccttccaccgcctctggttttgtccccgccagcggctccgactccatcgcgtcctcttccagtctagtgcttttttccagatctcgatcccaaactccctcctgccagaatctggacccgaatccacccattgcccattttccgctgccgctggagagaatctctgaggtccccaggacagcctgcctgcacggaagagatgcctcctcaggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttgatgcggccggaaaccatccaatataatatactaataccatcaaacacaaa

SEQ ID NO: 281842 - DNA, 794 bp, Homo sapiens
gtataacagtttctctctaactcctcccactgagatgacccatagtaccccattccttgctgcaatgtaattacaagtgtgctcctggtggtctttaactgaagggcactgactgggtactggtgaagttccccgcaggaactgagtcagaccccatctcagggccctgcagaagataggtgcctgctctaaggcgtggaccctcgcgacagccctggcccgtcttgacgggcgagggttactgtacttgtcccaaccgtacagatgagaaagctcagactcagggccagcaaccccggtcccagcggagcgcccggcacgcgccgacacttcagcaccagtcgcggtggccaccactgtgcgcggagatggctgcgacgcgtgcgcagggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttgatgcggccggaaaccatccaatataatatactaataccatcaaacacaaa

SEQ ID NO: 281843 - DNA, 1047 bp, Homo sapiens
  misc_feature (8)..(8): n is a, c, g, or t
  misc_feature (77)..(77): n is a, c, g, or t
tttttttnaatgttagaattcttttttatttcctggaagctgagatacaaaaatggaaccaaaattcagtgatgtanatctttatcatatcttgcgtggtcctctttgtgcatcacagcagggtccatctgctctgggtccttatgacatgacactattctcagtgtcctggtatgttcccgacactgtacaatggctccaatcagccctactccaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcagatctcgatcccaaactccctcctgccagaatctggacccgaatccacccattgcccgttttctgctgccgctggagagaatctctgaggtccccaggagagcctgcctgcacggaagagacgcctcctcgggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttggtggtccaagttgatgtcttaaaaaaaattc

SEQ ID NO: 281844 - DNA, 2914 bp, Homo sapiens
  misc_feature (8)..(8): n is a, c, g, or t
  misc_feature (77)..(77): n is a, c, g, or t
tttttttnaatgttagaattcttttttatttcctggaagctgagatacaaaaatggaaccaaaattcagtgatgtanatctttatcatatcttgcgtggtcctctttgtgcatcacagcagggtccatctgctctgggtccttatgacatgacactattctcagtgtcctggtatgttcccgacactgtacaatggctccaatcagccctactccaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcagatctcgatcccaaactccctcctgccagaatctggacccgaatccacccattgcccgttttctgctgccgctggagagaatctctgaggtccccaggagagcctgcctgcacggaagagacgcctcctcggtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacgtagttgtaagagctagttattttagacaatgcctctgtgatcagggactctaatctggaaataggtagtcggagaggtcggtgatgcagtctctggatcagagacctgagctatatggggttagagaggggccctgggcaggcgagtctctggggagtgtgatgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgtttttcgcctctcattatttaaataatttgaagttttccccaataactagtgtcttagaagtcatgaaaatttcagaaaatgacaggtcttctgagttcgtgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgcgaatggcaggcattcagatctccaagaatagaggattaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaatcgggccaggcacgatggctcatgcatgtaatcccagcactttgggaggccaaggcaggcagatcacaaggtcatgagatcgagaccatcctggccaacatagtgaaacccgtctccaataaaaa

SEQ ID NO: 281845 - DNA, 1300 bp, Homo sapiens
cgagctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactccaaaaaaaaaaaaaaaaaaaaactcgaactagttctcctcgtgccgaattcggcacgagcggcacgaggttaaaagctgaaacaacttcaaggaaacttcagggaaaagagaaggcctggaatctgatcctccacttcagagaacaggggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagccaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccataca

SEQ ID NO: 281846 - DNA, 804 bp, Homo sapiens
tggcaaaggtgtatacatttgtcacagctcatgaaatggtatatgtggtcaactgtattttccaaagatggtcacaatagaagccattccacatgctcttaacaatgtaacactgtcattttttcatcaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagccaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccataca

SEQ ID NO: 281847 - DNA, 446 bp, Homo sapiens
ctggcactgaaaatgtggcatccagtccactttaccatcagtgtttaaggaaaccatctctgataaggatgactgaggaagagtactctttggcttgttgacaccagcacagctgacacacccagatatctgtttggtctcctgtgaactttcaaccaggatttaaggatgccactctggttaaaagctgaaacaacttcaaggaaacttcagggaaaagagaaggcctggaatctgatcctccacttcagagaacaggggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatctt

SEQ ID NO: 281848 - DNA, 359 bp, Homo sapiens
ctggcactgaaaatgtggcatccagtccactttaccatcagtgtttaaggaaaccatctctgataaggatgactgaggaagagtactctttggcttgttgacaccagcacagctgacacacccagatatctgtttggtctcctgtgaactttcaaccaggatttaaggatgccactctggttaaaagctgaaacaacttcaaggaaacttcagggaaaagagaaggcctggaatctgatcctccacttcagagaacagggagaaaaaagtacatgtgaaatactactacttatccatctcctggctctgagcagtacatgtcaggaacaagagggaattgtagctggaagacagtagaa

SEQ ID NO: 281849 - DNA, 604 bp, Homo sapiens
gttaaaaatacataatccttttattttataatgcaataaaagaaattaacaacatcacatacacagaagactaggaaaggggaaactacttacttctggaaatcagtaatgtaaacttacttgtacttttccatagtacatgaaagtaacgtttaacatgttttgaattaattaattaaatttaatctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggat

SEQ ID NO: 281850 - DNA, 1480 bp, Homo sapiens
  misc_feature (1472)..(1474): n is a, c, g, or t
  misc_feature (1476)..(1476): n is a, c, g, or t
  misc_feature (1478)..(1480): n is a, c, g, or t
ggggtggaaaaaaaaaaaaaaaaaaaaaaaaaaaaaaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaagannnanannn

SEQ ID NO: 281851 - DNA, 2239 bp, Homo sapiens
  misc_feature (2231)..(2233): n is a, c, g, or t
  misc_feature (2235)..(2235): n is a, c, g, or t
  misc_feature (2237)..(2239): n is a, c, g, or t
taaaatattttcattggctttgcaaatagcagaaaagttgtcaaaccaagggggaaaagctactgcaatatttctgcctctttagattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaagannnanannn

SEQ ID NO: 281852 - DNA, 3552 bp, Homo sapiens
  misc_feature (3544)..(3546): n is a, c, g, or t
  misc_feature (3548)..(3548): n is a, c, g, or t
  misc_feature (3550)..(3552): n is a, c, g, or t
tgcccgcgaagagactggggattccgaggcggctcctgggagaccggacgcgcgcggcctccgccgctcccagtcccgccagacccgatgccgggctggagaagcgcgggggccgacgcacctcggataggcgggggcaggggcaggggcagctctcctttaccctagagcggcgacagaagctcttcgggggatcagtggccaagggggcggacagatttgcacggcggattcctccgaagcaacccgtgtgaaagaagccaagcggaggctgcagcccgggccgcgatgggggtgacaccgcccgtggtcccgccccttcccgtggcccctcggagccacttccggcggcagcgtccgggctagttcctggcgcgagcggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcactgaggagcgggaggattgtaagatactgtgcctttgctccagggcatttgtggaggatcgaaaattgtacaatttgggattaaaaggctattacatcagagacagtggcaacaattcaggagaccaggcgacagaagaagaggaaggtggttattcctgtggtactgcagaatcacatgacagcaaaggcataggcctggatgaaagtgaacttgattctgaggctgaactcatgagaagtatgggattgccacttcaatttggtaggataactgcacataaggattttgaggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaagannnanannn

SEQ ID NO: 281853 - DNA, 424 bp, Homo sapiens
ctttgaaattttcagactttctaagaagatcactaataatattgtttattttcttccaagaaatgctgatattgaccaggtaagccattactgaaaaacttccatgagtgtctgtcttaactgttacaagtacggtaaaagatacaggacatatccttaccagagaatgtgtttatgagaagtccctgactcactgactattcttagaaagctggaagtatctggaagttagatccatgtctattacatcgtcttcatttccatagctcctggcatacatagacacaaatagagcactctaggctttgactagacatattgaaaggatgattgaatgtgttgtgcttcaaatgctgcatagttaaactagcctttttttatttgtttcagcctgggcaacaaagtgagactgtctcaaaaaaaa

SEQ ID NO: 281854 - DNA, 3829 bp, Homo sapiens
  misc_feature (3821)..(3823): n is a, c, g, or t
  misc_feature (3825)..(3825): n is a, c, g, or t
  misc_feature (3827)..(3829): n is a, c, g, or t
tgcccgcgaagagactggggattccgaggcggctcctgggagaccggacgcgcgcggcctccgccgctcccagtcccgccagacccgatgccgggctggagaagcgcgggggccgacgcacctcggataggcgggggcaggggcaggggcagctctcctttaccctagagcggcgacagaagctcttcgggggatcagtggccaagggggcggacagatttgcacggcggattcctccgaagcaacccgtgtgaaagaagccaagcggaggctgcagcccgggccgcgatgggggtgacaccgcccgtggtcccgccccttcccgtggcccctcggagccacttccggcggcagcgtccgggctagttcctggcgcgagcggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcactgaggagcgggaggattgtaagatactgtgcctttgctccagggcatttgtggaggatcgaaaattgtacaatttgggattaaaaggctattacatcagagacagtggcaacaattcaggagaccaggcgacagaagaagaggaaggtggttattcctgtggtactgcagaatcacatgacagcaaaggcataggcctggatgaaagtgaacttgattctgaggctgaactcatgagaagtatgggattgccacttcaatttggtaggataactgcacataaggattttgaggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaagannnanannn

SEQ ID NO: 281855 - DNA, 3176 bp, Homo sapiens
  misc_feature (3168)..(3170): n is a, c, g, or t
  misc_feature (3172)..(3172): n is a, c, g, or t
  misc_feature (3174)..(3176): n is a, c, g, or t
aattcgcggccgcgtcgactacggccgagaccaggcgacagaagaagaggaaggtggttattcctgtggtactgcagaatcacatgacagcaaaggcataggcctggatgaaagtgaacttgattctgaggctgaactcatgagaagtatgggattgccacttcaatttggtaggataactgcacataaggattttgaggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaagannnanannn

SEQ ID NO: 281856 - DNA, 711 bp, Homo sapiens
ttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcactgaggagcgggaggattgtaagatactgtgcctttgctccagggcatttgtggagtaagtagaaaagagaatctcttcatgttctagcacagtcattacccagaaatgtaggtattgcaaacgtggttgtaattgatccctgaaagcagccagaacatctgacccttgggcacggtgatgtttaagaaaaacaaaaccctcagacatgacggagtggtcgcccactgccattatttttatgtgaaggactacatctacttggtaggctgctatgaaaaaatgtcgtaggtgctatatgtcatctcatatttgtaaatcgaggggacatttaaaaattgggggaaagcgacatgtaaaatgaaatctctagtagatatgatgtcataaagtgaaagtttaaagttgagtgacttgctttggttaacgtctttttttaaacctaaaaatctacttaagcccaaatgcacataattaaaacttcaaactagttgagataaaagacttaaccatatttacatcagtttttgtgatatctttattttggg

SEQ ID NO: 281857 - DNA, 3574 bp, Homo sapiens
gcggcggcggcgctgagccgggcccgggtgtgggggcgcctatatccccagcccaagctgcaggaagccgcgccgcttcctcggaggggctgggacggcggcggccacgtggggggcgggggcgacgctcggggcccgcggctggagggggagtcgctgcctcacccgcgcctggcgcccgcggctccctccgcctcgccggcgttggcccaccctctcgtagctcaccccgcgaggctggacagctcccggaaccccggaaccgggatctatttcgggggctcggctgcgtggcgcccaggactctccagggtctcccaggatcgctccccgaattcgagtcgccccctctctctttcgggaataccagctgatgtcagtccgccagccaaaaccagggaggagaagcgggagccagccctctggagtcgggagaaggtctggggagtggggtagaggggaaagcaaagtccaaataccttcccttcagacacctcctggggcctagaccccacaaacctgttgtggggagggcaaaatacgatgactacgttcccaggaagaaggtgccacagctcttcaggaccacggttgggagaaagaatggaggggttttagaaccttcagtgtgcgacttcatgtgccagtcttcatctcaggatctcaagctcttggatcatgggcacggataacctgttgtcctcctctatggtcaagaggctgcttttgcaaagaatccagtgggagagagtcaatggcctgcttgacgtgaactccaaagtcctcctggccaagggtcatcctgcctggagcagggcaagaggtgacttgacccttaggaagagtggcatctctaatcttcaacttccaccaccaccacacacacaaatgcagagccacccaggaggaagtaaaaagtgctagggccttctacaccttgaaattatatgtggagcatcctgcaataagcatctctgtgatgcacagtcattcacacctgctggtctctcccccagctgtctgcaaaatgaagagcagagcacaagagaacatgtgagaaagaggcagggtcggggaagccagaagtcctggctggcaggggctgatccttcctaactagagagaggagacacacttcttgagagggcagggagatagcagggagaactagaggagctatagccagggagccagctaagggagggaagacaaaggagtggagacacaactactccatctctccccagcctcctcatctccagaatgatggcacacctgggaggggcctgactacctttcagggggaaaaatggtcactgggcctggtgcggtggctcatgcctgtcatcccagcactttgggaggccaaggtgggtggataacctgaggtcaggagttcgagaccagccagaacaacatggtgaaaccccatctctactaaaaatacaaaaatttgctgggcgtggtggtgcctgcctgtaatccagctacttaggaggctgaggcaggaaaatcgcttgaacccgaaaggcagaggttgcagtgtgccgagattaagccactgaactccagcctgggcaacaagagtgaaactctgtctgaaggaaaaaaaaaaaagccattggagaagacggggtccttccagagaagctgatcaagtcatattactcatcaactgctggggacctaacagtcactaccatgtattgaacacttactatgggctgcataatgtgcctactgacgcatgtgctgaaagctttgcatgtatgtcttaaagccacaccactataacatcagaattatcttctccatgtgtgaaatggggaaacaggaggagaaagtttacaatcccagagctagtaattggcagagccaggatttaaacccaggatatcttgatgctaaagttcatgtcttaaccattatgatttatcacctcctctcactgcagatcagaataccaatttcttactgggtctggaaaggaggagagaaggatagagagtttcttctaggaccaaattgattcctccacaaataggaagatccccagactgtgtgcacacaccctcctcctccttccttctccaaccctggctggaccatgacatcacatggtggaggctgttttttaaaaagaactcaggccagatttacaagaatgatgctcaggcagcgtgactgtcaaggaccgtggccaagtgacccatagcacacacccagcagtgctgagaacatagctagtcccttagcacctggggctgactcatggttgctgtaggacccaatgccagatgccaggattgctttctccctccattcattaggactgtcccatgaaaccctccccaggaacccttctaccccatcccggcatgccaggagcctggatactgcataacacagggtactcatatttgtttaccaagccttgaagatgacaggcaatatgctgatatgctcaatgcatcatacaaattgttttatttaaaactgaactattaaattaagtatcatagcaactcactttacagacaaggaaactgaagctcaaaggttaagtaagggccaggcatggtggctcactcctgtaatcccagcagtttgggaggctgaggtgggaggaggattgcttaagcccgcgagtttgagaccagcctaggcaatatagggagaccccatctctacaaaaaattatctgggcctggtgatgtgtgcctgtagtcccagctacttgagaggctgaggtgggaggattgcttgagcccagaagttgaggctgcagtgagccatgatcatgccattgtactccagcctgggcagcaaagcaaaaccctgtattgaaaacaaacaaacaggctgggcacggtggctcacacctgtaatcccaacactttgggaggccgaggcaggtggatcacctgaggtcaggagttagagaccagcctggccaacatggtgaaacccgcctctactgaaaatacaaaaattagcagggcattgtggcacatgccaaggtgggcagatcacctgaggtcaggagttcgagaccagcctggccaacatggtgaaaccccatctctactaaaaatacaaaaattagctgggcgtggtggtgggcgcctgtagtcccagctactcaggaggctgaggcaggagaatcgcttgaacctgggaggtggaggttgcagtaagccaagatagtgccactgcactccagcctgggcgacagacaaaaaaaaaaaaaaaaagaagttggagcagtgtgaagaagaggtgagaacaacccccggactgatcaaagcccacatgccactgcatcccgcgtccagcgcctacatcctgccaccgtcgctgccaccaccatgcccaagagaaaggctaaaggggatgctaaaggagacaaagccaaggtgaaggacgaaccatagagaagatccacaaggttgtctgctaaacctgctcctccaaagccacagcccaagcctaaaaaggcccctgcaaagaagggagagaagatacccaaagggaaaaagggaaaagctgatgctggcaaggaggggaataaccc

SEQ ID NO: 281858 - DNA, 2288 bp, Homo sapiens
gcggcggcggcgctgagccgggcccgggtgtgggggcgcctatatccccagcccaagctgcaggaagccgcgccgcttcctcggaggggctgggacggcggcggccacgtggggggcgggggcgacgctcggggcccgcggctggagggggagtcgctgcctcacccgcgcctggcgcccgcggctccctccgcctcgccggcgttggcccaccctctcgtagctcaccccgcgaggctggacagctcccggaaccccggaaccgggatctatttcgggggctcggctgcgtggcgcccaggactctccagggtctcccaggatcgctccccgaattcgagtcgccccctctctctttcgggaataccagctgatgtcagtccgccagccaaaaccagggaggagaagcgggagccagccctctggagtcgggagaaggaagaaggtgccacagctcttcaggaccacggttgggagaaagaatggaggggttttagaaccttcagtgtgcgacttcatgtgccagtcttcatctcaggatctcaagctcttggatcatgggcacggataacctgttgtcctcctctatggtcaagaggctgcttttgcaaagaatccagtgggagagagtcaatggcctgcttgacgtgaactccaaagtcctcctgatcagaataccaatttcttactgggtctggaaaggaggagagaaggatagagagtttcttctaggaccaaattgattcctccacaaataggaagatccccagactgtgtgcacacaccctcctcctccttccttctccaaccctggctggaccatgacatcacatggtggaggctgttttttaaaaagaactcaggccagatttacaagaatgatgctcaggcagcgtgactgtcaaggaccgtggccaagtgacccatagcacacacccagcagtgctgagaacatagctagtcccttagcacctggggctgactcatggttgctgtaggacccaatgccagatgccaggattgctttctccctccattcattaggactgtcccatgaaaccctccccaggaacccttctaccccatcccggcatgccaggagcctggatactgcataacacagggtactcatatttgtttaccaagccttgaagatgacaggcaatatgctgatatgctcaatgcatcatacaaattgttttatttaaaactgaactattaaattaagtatcatagcaactcactttacagacaaggaaactgaagctcaaaggttaagtaagggccaggcatggtggctcactcctgtaatcccagcagtttgggaggctgaggtgggaggaggattgcttaagcccgcgagtttgagaccagcctaggcaatatagggagaccccatctctacaaaaaattatctgggcctggtgatgtgtgcctgtagtcccagctacttgagaggctgaggtgggaggattgcttgagcccagaagttgaggctgcagtgagccatgatcatgccattgtactccagcctgggcagcaaagcaaaaccctgtattgaaaacaaacaaacaggctgggcacggtggctcacacctgtaatcccaacactttgggaggccgaggcaggtggatcacctgaggtcaggagttagagaccagcctggccaacatggtgaaacccgcctctactgaaaatacaaaaattagcagggcattgtggcacatgccaaggtgggcagatcacctgaggtcaggagttcgagaccagcctggccaacatggtgaaaccccatctctactaaaaatacaaaaattagctgggcgtggtggtgggcgcctgtagtcccagctactcaggaggctgaggcaggagaatcgcttgaacctgggaggtggaggttgcagtaagccaagatagtgccactgcactccagcctgggcgacagacaaaaaaaaaaaaaaaaagaagttggagcagtgtgaagaagaggtgagaacaacccccggactgatcaaagcccacatgccactgcatcccgcgtccagcgcctacatcctgccaccgtcgctgccaccaccatgcccaagagaaaggctaaaggggatgctaaaggagacaaagccaaggtgaaggacgaaccatagagaagatccacaaggttgtctgctaaacctgctcctccaaagccacagcccaagcctaaaaaggcccctgcaaagaagggagagaagatacccaaagggaaaaagggaaaagctgatgctggcaaggaggggaataaccc

SEQ ID NO: 281859 - DNA, 2456 bp, Homo sapiens
gcggcggcggcgctgagccgggcccgggtgtgggggcgcctatatccccagcccaagctgcaggaagccgcgccgcttcctcggaggggctgggacggcggcggccacgtggggggcgggggcgacgctcggggcccgcggctggagggggagtcgctgcctcacccgcgcctggcgcccgcggctccctccgcctcgccggcgttggcccaccctctcgtagctcaccccgcgaggctggacagctcccggaaccccggaaccgggatctatttcgggggctcggctgcgtggcgcccaggactctccagggtctcccaggatcgctccccgaattcgagtcgccccctctctctttcgggtctggaggggtcggcaagctgctctcccagacgtggagaagagggagggggctgggagctccagcggcctctcgacgccgctgcttctaaggggctgtcctgggttgtgggggaaggggcgcctggagctgagccacgcagctcagggttccttatcctatccctaggaataccagctgatgtcagtccgccagccaaaaccagggaggagaagcgggagccagccctctggagtcgggagaaggaagaaggtgccacagctcttcaggaccacggttgggagaaagaatggaggggttttagaaccttcagtgtgcgacttcatgtgccagtcttcatctcaggatctcaagctcttggatcatgggcacggataacctgttgtcctcctctatggtcaagaggctgcttttgcaaagaatccagtgggagagagtcaatggcctgcttgacgtgaactccaaagtcctcctgatcagaataccaatttcttactgggtctggaaaggaggagagaaggatagagagtttcttctaggaccaaattgattcctccacaaataggaagatccccagactgtgtgcacacaccctcctcctccttccttctccaaccctggctggaccatgacatcacatggtggaggctgttttttaaaaagaactcaggccagatttacaagaatgatgctcaggcagcgtgactgtcaaggaccgtggccaagtgacccatagcacacacccagcagtgctgagaacatagctagtcccttagcacctggggctgactcatggttgctgtaggacccaatgccagatgccaggattgctttctccctccattcattaggactgtcccatgaaaccctccccaggaacccttctaccccatcccggcatgccaggagcctggatactgcataacacagggtactcatatttgtttaccaagccttgaagatgacaggcaatatgctgatatgctcaatgcatcatacaaattgttttatttaaaactgaactattaaattaagtatcatagcaactcactttacagacaaggaaactgaagctcaaaggttaagtaagggccaggcatggtggctcactcctgtaatcccagcagtttgggaggctgaggtgggaggaggattgcttaagcccgcgagtttgagaccagcctaggcaatatagggagaccccatctctacaaaaaattatctgggcctggtgatgtgtgcctgtagtcccagctacttgagaggctgaggtgggaggattgcttgagcccagaagttgaggctgcagtgagccatgatcatgccattgtactccagcctgggcagcaaagcaaaaccctgtattgaaaacaaacaaacaggctgggcacggtggctcacacctgtaatcccaacactttgggaggccgaggcaggtggatcacctgaggtcaggagttagagaccagcctggccaacatggtgaaacccgcctctactgaaaatacaaaaattagcagggcattgtggcacatgccaaggtgggcagatcacctgaggtcaggagttcgagaccagcctggccaacatggtgaaaccccatctctactaaaaatacaaaaattagctgggcgtggtggtgggcgcctgtagtcccagctactcaggaggctgaggcaggagaatcgcttgaacctgggaggtggaggttgcagtaagccaagatagtgccactgcactccagcctgggcgacagacaaaaaaaaaaaaaaaaagaagttggagcagtgtgaagaagaggtgagaacaacccccggactgatcaaagcccacatgccactgcatcccgcgtccagcgcctacatcctgccaccgtcgctgccaccaccatgcccaagagaaaggctaaaggggatgctaaaggagacaaagccaaggtgaaggacgaaccatagagaagatccacaaggttgtctgctaaacctgctcctccaaagccacagcccaagcctaaaaaggcccctgcaaagaagggagagaagatacccaaagggaaaaagggaaaagctgatgctggcaaggaggggaataaccc

SEQ ID NO: 281860 - DNA, 839 bp, Homo sapiens
  misc_feature (11)..(11): n is a, c, g, or t
  misc_feature (660)..(660): n is a, c, g, or t
  misc_feature (668)..(669): n is a, c, g, or t
  misc_feature (688)..(688): n is a, c, g, or t
ctatacgggcntaagtacaggctcggtggctttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagntcggaggnnatcatgtcttgtgacggangtggcacaatgagacaatgggaaggaagagcccgaaaccgtattgattaaagcccagagttacacagttccaatgggttgccccgttaaacaccggcacactagagtgccctaaggacttaagcaatgttgtggaccctcaatgaaagttt

SEQ ID NO: 281861 - DNA, 788 bp, Homo sapiens
ggcaggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatgattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagaatatgggaagttggcgagcccctttcctggtagctgggacctatttcaccttgtacagaaacttggaggtttgcccctgaccaccctcgagatcgtgcagcactgactggctactgctctcggttctccaggtcttcgaagccgctccactcgcatgtccactgtctcagagcttcgcatcacggctcaggagaatgacatggaggtggagctgcctgcagctgcaaactcccgcaagcagttttcagttcctcgtgagtaacgaatgtgcccccaa

SEQ ID NO: 281862 - DNA, 2885 bp, Homo sapiens
aggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281863 - DNA, 2846 bp, Homo sapiens
aggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacaggcaaggttgccattccatccccttggagcctcaagcctcgaagcctgggcggtgccacattcctctgttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281864 - DNA, 2864 bp, Homo sapiens
ggcaggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatgattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcagatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281865 - DNA, 1975 bp, Homo sapiens
cggacgcgtgggtcgacccacgaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281866 - DNA, 2010 bp, Homo sapiens
gtgggggacacttcagggtactaccagcggatgttggtggttctccttcaggctaacagagaccctgatgctggaattgatgaagctcaagttgaacaagatgctcaggctttatttatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281867 - DNA, 2364 bp, Homo sapiens
aggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281868 - DNA, 450 bp, Homo sapiens
gtggaaaagcaacttgttttgcatatggccagacaggaagtggcaagacacatgtgagtattgaggcctggcggggaaagagcctttcccttgtgcacccctggctccctataaagggagacaatgagtttgttgagaaaggccccttgttacagatgccccatcaccagatagccttgccatgtcagatgcagggaggggctttaggtccagccttctggctttgttgtggcccactgtagtgaaggagccagtagtgctctgctctaggccaacagcccttttccatggtcttctaccccttccctttgcagactatgggcggagacctctctgggaaagcccagaatgcatccaaagggatctatgccatggcctgtaagtactgtgtactgctgcttcagggttgggcacagaaaggcaggttgtttgcttagcaaagttctctcc

SEQ ID NO: 281869 - DNA, 511 bp, Homo sapiens
gacagaacaaggctcacaccccgttccgtgagagcaagctgacacaggtgctgagggactccttcattggggagaactctaggacttgcatggtgagtagggtcactttgaaggtgatggtacaggaggagacagagttgctttccacagagacacttagtcctgtccctgggctggaagctcagcactgctggctgcctgggtttccaggctgtaccgtgactgggcttccagaccctgctttaatgcacgagactccttgtggcctaaccaagcgtggaggaaaggatctattccctttaagatgtgtaggtgcagctcttggtttgggagaggtcattcctgcattacctgatgaaaagggggttccagaattcggaagatgggcctttgggtcagcaggagagggaagtccttgtcttttccatggcctccctcaggttcactggctcccagcctagaaaatagaaatagcctggatcataaggctgtgtccttgaatgacgtcctc

SEQ ID NO: 281870 - DNA, 856 bp, Homo sapiens
  misc_feature (681)..(681): n is a, c, g, or t
  misc_feature (689)..(690): n is a, c, g, or t
  misc_feature (709)..(709): n is a, c, g, or t
aggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagntcggaggnnatcatgtcttgtgacggangtggacccctgagaacagcgagagagaagatgcctgaatcctgaatggattgagaggccccgagttgacggtgttccccggattgccctgttagattcggcctgggttcctttgcggcttgggcccttttgttacccgtacatgccc

SEQ ID NO: 281871 - DNA, 2960 bp, Homo sapiens
ggcaggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatgattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281872 - DNA, 2762 bp, Homo sapiens
aggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281873 - DNA, 2341 bp, Homo sapiens
aagctagtgaggcccacatggggaggggtctgatctttataaactgggttccacccccataccataggttggctagattcctgcattagtaaaaatcatgaaagtagtgctgaaactcttgtaggcagcagagtgagaaaaatgggaacaaaatccagtgctcccttcttgtgctctggagtatctaatggaggatgcaggggtcctagtgttagatcttggcctctgactgggccagacatgggattggaaggggtgggagttctggacaagctcgcttttgaaattgctctgaccctttgctgttggttgcctcctctcatccgcttgcagatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281874 - DNA, 2418 bp, Homo sapiens
aggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281875 - DNA, 936 bp, Homo sapiens
  misc_feature (10)..(10): n is a, c, g, or t
  misc_feature (14)..(14): n is a, c, g, or t
  misc_feature (19)..(19): n is a, c, g, or t
  misc_feature (53)..(53): n is a, c, g, or t
  misc_feature (57)..(57): n is a, c, g, or t
ctttgatggnccancatgngcacgtgcacacacacacagaggcatatgtcacncacngcatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 281876 - DNA, 493 bp, Homo sapiens
gctgtgggatctgagacctccttgtttcctcagggtcaaggagctgagcccccacagtgggcccagtggagagcagttgattcaaatggaaacagaagagatggaagcctgctctaacggggcgctgattccaggcaatatgtaaggaccaggatgcggccaagcaagacagaagtgtggcctgctgaggcggcacctgggtcacataattgtctttctttttggccctctcagttatccaaggaagaggaggaactgtcttcccagatgtccagctttaacgaagccatgactcagatcagggagctggaggagaaggctatggaagagctcaaggagatcatacagaggcagctggccctggacagggagctggatgcagcacggccctcagtatgctccacaccattcccagaacatgacctgggccttgttcccacaggtattcacatagcaagaagcagccctctacaccagcactctttaattcttt

SEQ ID NO: 281877 - DNA, 256 bp, Homo sapiens
tcaggaggatttgagccccaaatccaacaacaggaacaacaaagaaggttgcagactatgctgttctgcagtttctttattttaggaagtccagggggcccaggcaagccagggaggccagggctacccagagaaccctggaaagcaaaaacaaagtccccggagttactgtcactgcaacactgaaagcacggaaggcagaaacaaccttgggtgtgttgacttgtgtctaaaataaacgtgctgtggttggttg

SEQ ID NO: 281878 - DNA, 484 bp, Homo sapiens
gaggatcatgtctgcatcttaaaagatccctttctgtagacaatggactgaagggggtgaccagtcaggaggcagttgctgcattgcaagatgaaatgctggaagtggtagggattgatgcagacctccttctgcttggaaccaaaaggaaactcacagcattccagtggttttagttcatggtggctctgaagatcgggccagcgccacacacggcagtaaatgacatgaggcagtcccttccggtgggagacttgcagcctgccatccagagagcggggaatggtgacacagttactcggttgccctgggcagctcaaggccttttccagttcctccatggcacctttctttttcttcagttttttcaccaaagcatcaacagctttctctgcccatttttcttcttcatcgccctgtttccacccaagaagtctcttcacagctggacttgtaaaggaaaataaacttgtcacattcataa

SEQ ID NO: 281879 - DNA, 834 bp, Homo sapiens
cgaccaccatgacgaaaataaggaacctgaggagcccggaaggcatgacatcaccgttcctcctcccagctaccgaaggcgccgcgcgctgacctcacaaacacggcttctcctggtacgggctggttacgccctccagctgcgccccctacacgacgacagacgcgtcccccagcccttctcctgtcctaccacttgtggcggccatgaaggggacccccagctccctggacaccctgatgtggatctaccacttccacagctccaccgaggtggccctccagcccccgcttctgtcttccctggaactctccgtggccgcagcccatgaatatctggagcagaggttcagagagctgaagtccctggagccacccgaaccgaagatgcaggggatgctgcctgccccgaagcccaccctggggctggtgttgagagaagccacagccagcctcgtgagcttcggcaccaccttgttagaggtggggtactggggggcttaggatacgcggcgatcgggtagcgggaacaaggacctctgcctccccgctaacccctgtgcccccaatgcagatctcagccctgtggctgcagcaggaggcgcggcgactagacggcagcgcgggcccagccccagacggcagggatccgggtgcagcgctgagccgggtagcccaagccgcagggcagggggttcggcaagctggggctgcggtgggcgccagcgcccggctcctagtccagggagcatggctatgcctgtgtggacggggtctgcaggggtctgcctcattcctgcgacagtcgcaacagcagctaggcctcggaatcccc

SEQ ID NO: 281880 - DNA, 763 bp, Homo sapiens
agcgcaagtctctgaggcacgggaggggcggacgcagagaccgagcgcctaatgtggctagcggatcgtctgctccccggacccaggaactacccgaagcccgcgcggacccacagaccacccccagctccgccccgcgaggccccgcctcttcatgcaacctaaaagtaaccaactccccccacgcgaaggttcctatcggtcgacgggctgtgggtgtattgctcagtgacggcttcgtttagtttctcccagcacccataattcaaagcaagaacaacgacattatggggagaaaacgtccttttgtgaaacagaaggcaatccacaccattagtaaaccccatcaattttgccttcagaatatatccagattcttcccaattctaccgccaccattctggttcaagctacctgtagagacggggtttcaccatgttagccaggatggtctcgatcttctgacctcgtgatccgtccgcctcagccttccaaagttctgggattacagacgtgagccaccgcgcccggccaaaagatccataaactttgagtcaccagatagagctaacatttaccacagaggcatgtaaagaaaacgattctagcagagtaactataatacaaaagaacaatattccaattatgttcctatgttctatccaggaaggtttaagaggagccttttaaactgaactatattctaagaggtgggaaaaagttttcttttgtttttcttattaaccgtaccttgaaagcccca

SEQ ID NO: 281881 - DNA, 874 bp, Homo sapiens
agcgcaagtctctgaggcacgggaggggcggacgcagagaccgagcgcctaatgtggctagcggatcgtctgctccccggacccaggaactacccgaagcccgcgcggacccacagaccacccccagctccgccccgcgaggccccgcctcttcatgcaacctaaaagtaaccaactccccccacgcgaaggttcctatcggtcgacgggctgtgggtgtattgctcagtgacggcttcgtttagtttctcccagcacccataattcaaagcaagaacaacgacattatggggagaaaacgtccttttgtgaaacagaaggcaatccacaccattagtaaaccccatcaattttgccttcagaatatatccagattcttcccaattctaccgccaccattctggttcaagctacctggtaaaacatgcacagagcaaatttcggttgtatcctagaaatgatagccatattgaggatactggttacacctgacgaaacatctccatgaaagttaagcatacacaggatctcactttgttacccaggctagagtgcaatggtgtgaccacagctcactgaagcctcaacctcctgagctcacttttaagcaatcctctcacttcggcctcctgagtagctgggcctacaggcatgtaccaacactcccagcaagtttttcttatttttgtgaagacagagtcttgcagtattgcccaagctggacttgaactcctggcctcaagcaatcctcccatctaggcctcccaaagtgctaggattacaggcatgagccactgtgccaagcaacacttgcagtttttaagtgaaaatgatcctgtaaatatatatatgaataaaatctagaaagctatat

SEQ ID NO: 281882 - DNA, 872 bp, Homo sapiens
tccatggcaaaaatcattattttttttaagtttcattttgagtattagcagctataggatcttcagggttatcctccttgaagtatttcctatggtcaccctggactaatgtctttaaataaaacacataatattaaagggtccataccgacagtgaataagctatcaatgctagccaatcagtgttggggagaagcacaggaaagccttaggaaaaatattgggaaaattggaggtcttctgtttgccaatacttcagatcaatttctgcattagttttcttccatacccagaattgcatagaattaaggaggatgtaaagccagaagaagcctaaaggcagattctggttcagtcactatgaaattcttacattctcaaatatacttctttacatttttatctaaaattttaggtaaaacatgcacagagcaaatttcggttgtatcctagaaatgatagccatattgaggatactggttacacctgacgaaacatctccatgaaagttaagcatacacaggatctcactttgttacccaggctagagtgcaatggtgtgaccacagctcactgaagcctcaacctcctgagctcacttttaagcaatcctctcacttcggcctcctgagtagctgggcctacaggcatgtaccaacactcccagcaagtttttcttatttttgtgaagacagagtcttgcagtattgcccaagctggacttgaactcctggcctcaagcaatcctcccatctaggcctcccaaagtgctaggattacaggcatgagccactgtgccaagcaacacttgcagtttttaagtgaaaatgatcctgtaaatatatatatgaataaaatctagaaagctatat

SEQ ID NO: 281883 - DNA, 1804 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281884 - DNA, 1889 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagaggaggaggattagagtcaaaggtgtggggaggcttgtgagcttctgtgagttgttgtgtgtggcttgtatacatgctgttatactgattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281885 - DNA, 1759 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagaggccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281886 - DNA, 1273 bp, Homo sapiens
taataccgaaacgaggaggtttaaggtaaacttacgaaaggggaccctttaaagaacacgcacagttttaagacgagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281887 - DNA, 1734 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281888 - DNA, 1335 bp, Homo sapiens
gttggtgaagggtggaaggctgggtaccagctgatggtcagcttgcctctacggatgttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281889 - DNA, 1730 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaagattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281890 - DNA, 2173 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggggaccatataccagggattttcttgcaagagcaaagcagtggcctccctttgcagagggtcggtcggcagctgcctggacttcgggcgtctcagctggcagtgccacctcctcatcctgatgccgagttggatcacttatgtgattgtagtttttgtgtacctttggcagttttaatctcagctatttgatgatctggaggacatgaagtagattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281891 - DNA, 2098 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagt

SEQ ID NO: 281892 - DNA, 1961 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281893 - DNA, 1916 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagaggccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281894 - DNA, 1891 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacgaagggggatggacacaacgaagggggatggacac

SEQ ID NO: 281895 - DNA, 1297 bp, Homo sapiens
  misc_feature (218)..(218): n is a, c, g, or t
  misc_feature (1262)..(1262): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataaggatgcggccagcatatgggaganaatcactggttttaatatgttcaccatatcacaca

SEQ ID NO: 281896 - DNA, 1597 bp, Homo sapiens
  misc_feature (218)..(218): n is a, c, g, or t
ctggatctcggccacggatcttttgctcgcgaaagttcctccgtctagctgcacacaacgctgctgcaggaaaccgaggtaagggatttgccgagacttagctccaccacactccccgaggccccgccctcctctctggccctcccctaggcccaggtgtctcgcgttgcacgtgcagttgttgtggttctacgtcacgtggtcccggaagtcaaganagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctgagatgtgtccagcgccccctgtggtgtgtgagagaaagcagctgcaactcaagtgactaggtgggcccagctggcttcgtgcaggagggcacgacggacagattctacgccttacagacagacaggacttaaacctaaaaggaaaagccattcactgcaagtgtggatggcacttgcacccctggctctacagacagggaagcctgttgcaggggcatccacacatgagcagtgctcacctgaagctccttccggcgcatgtggagtcccaccgcacagcagcctaggggtctatgaagtgcaatataaatccaaggccttccatccttcccaccccgcaccaaaaactcctgtgaacaaatgtggttgtagcctctataaattccagccatgcgttaaggcaccagaactatttccccaccccctccaaaattaaacagcaacctgatacgaaaaa

SEQ ID NO: 281897 - DNA, 3757 bp, Homo sapiens
cgaacactggcctgaccctgggctttagaaacccatggacaacaggaaggaagcttattaacccctctcttccccctccctcttctccccggtggagaatcagctcctcctcctcccggtcgtgagaccctggtgcaaaatgcaaacaaccacccgctttccccaccctgcgcgcttctcccagaggagggagagggaagaggcgagggcgcagccccaagccgagtccagcaagtctgtcaatcggacgtgaacgtcccgacgagacaacttgaacctcagggccctcgcgccagccggacaccgcaggtaccccctttacctgcttctctgctgggtttgcatccgataccccaactcctagcctcattttccccccagccccataatattccggacccctgctccccgtgcaggtggtgcaaacgcccctgctctccggcgccccctgccgggaagagggaaggcggcggcggccgcggaggagcaggacgcttggtccggacggagctcggcgctgggaagaagccgggagcttccctgatggtgccgccgcctccgagccggggaggagctgccaggggccagctgggcaggagcctgggtccgctgctgctgctcctggcgttgggacacacgtggacctacagagaggagccggaggacggcgacagagaaatctgctcagagagcaaaatcgcgacgactaaatacccgtgtctgaagtcttcaggcgagctcaccacatgctacaggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctagaatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcattaa

SEQ ID NO: 281898 - DNA, 668 bp, Homo sapiens
gaggagcaggacgcttggtccggacggagctcggcgctgggaagaagccgggagcttccctgatggtgccgccgcctccgagccggggaggagctgccaggggccagctgggcaggagcctgggtccgctgctgctgctcctggcgttgggacacacgtggacctacagagaggagccggaggacggcgacaggtaagcgctgcaagccccagcggagggcgagctcctgcttgatgcgcgcccggctcgcggggtgcgggcggtcctccccggcgcccactcccacagcgatccgcacgccctcacttctccggggataaggagagtgctcagctgtcctgggcgacacttccctccgctcccgggtatcagcctttgcgccctgccatccgtgggtcgcgtcagggatacccttcgccccgcgttcctgcctccccccgggtgccacactggctggcacagctcgtgaaccccgcttcctttctcctggagctggttcgcttcgtcgtgaccctcgcgtggctcgtccctgtggccggagtctgccccgcgtacgcgtttggggaccagcccctgcccagagcgccgggacggggagcctggcgatccccacgcgccagggattccccagcgcgcgctgcccgcctccgctctcccgctgagaatc

SEQ ID NO: 281899 - DNA, 739 bp, Homo sapiens
cggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcagctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 281900 - DNA, 861 bp, Homo sapiens
gaattcggcacgagccacccccaacctcaagttgccgccgggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 281901 - DNA, 784 bp, Homo sapiens
tgactctagacgatcgccttatagtcgctctggaccgtccagaagccatcactgctatcatcgtggtcttctccctcttggctgccttgctcctggctgtggggctggcactgttggtgcggaagcttcgggagaagcggcagacggagggcacctaccggcccagtagcgaggagcagcccgcgtgccaccgacccctaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 281902 - DNA, 701 bp, Homo sapiens
aaaaaactggcagaatttgcagtgtgatcagcaagtctacgctgaggatgcccatcttctctgcctcctgaccccagcataaagacatgggatatgtgagaaaaggaataggaaaaagccaaagagacaccggcttacattagaaaatctactcaaaatcactcaaaggattgacaactgacaaaataaatggtggccagatgcagtggcttaggcctgtaatcctagcactttgggaggccaaggtggaagaactgcttgagtccaggagttcaagaccagcctggacaacacggtgaaaccgtgtctctacaaaaaacacaaaaacattagccaggcatagtggcatgtgcctgaagtctcagctacccgggaggctgaggaggaaggatcacctgagacctggaggttaagacttacattgagccacgatcacaccagccctccagcctgggtgcaaaccagctctcctctactagagtttggaagactttcaaccaatcagtcgttcagaaaataatactggatacctactaagttcaaggcattgtttgtgctatatgaacacagcaatgaacaacaataataacaataaataaacaaaaactcatctatactcatggagtttacagtcaaggggccaagagagaaaattaagaaataaaatgaatgaactcctcaatctgaacagatcaatggtg

SEQ ID NO: 281903 - DNA, 944 bp, Homo sapiens
  misc_feature (893)..(893): n is a, c, g, or t
cggacgcgtgggtcgacccacgcgtcgcggacgcgtgggcgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattctctttttttcctatttgtgtnttcaaaaggcggggttccaggtgagaaccgggtgtttgtaggtaaaaatgc

SEQ ID NO: 281904 - DNA, 239 bp, Homo sapiens
atatcgtcgacccacgcgtccgccacgcgtccgctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281905 - DNA, 1285 bp, Homo sapiens
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281906 - DNA, 1194 bp, Homo sapiens
cggacgcgtgggtcgacccacgcgtcgcggacgcgtgggcgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281907 - DNA, 1632 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281908 - DNA, 1942 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttcgcggcggggaccatgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccggggggggcggggggggtggagagaggtcggcagatccagctctccagcttggcaacctgcttagtctttctgaatctggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281909 - DNA, 2480 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttcgcggcggggaccatgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccggggggggcggggggggtggagagaggtcggcagatccagctctccagcttggcaacctgcttagtctttctgaatctggtatttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtgcgtgttatcagtgaagggaattaaaatgctgcataacgactttaacgaatatttttgctagccgtttagtcctgaaagtgtttatcaaattgtaggccattcgtggaaaaatctaatgcatgtagattttattacaaggtacagaaaaattaagactctttgtgggaacagtaaagttacatcattcacccaaaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281910 - DNA, 1764 bp, Homo sapiens
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgaaaaaaatacaaacacccctaaccaccacctcaacacacaaggacacaccacagaacgaaacgagcacgccacacagacccacacccacagaagagcactgacggaggcgcgaaggagcgcagcgcaagaggagaagacaagaggaagcagaggagacacaaacaccaacgacatgacagcgcgacttcggacgcggggagagagatagatagacgaggagcggcgtgcaggtccacgcgagacggagagacaaacaagcagagaaaacgacagagcaggagaaacggtagaatggacgagacatcacgacgaacagccatggcagtgaggcacaggcaagacatatgacgactgcataaggcaggcaacacaatcgaggtcagcaagaagagaacggtcggtgcccccgcgcgtcactgtgctggcgctaaccagacggcgcgagcggacacggcgagcaaagtcgaggacaaagacca

SEQ ID NO: 281911 - DNA, 1035 bp, Homo sapiens
  misc_feature (984)..(984): n is a, c, g, or t
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattctctttttttcctatttgtgtnttcaaaaggcggggttccaggtgagaaccgggtgtttgtaggtaaaaatgc

SEQ ID NO: 281912 - DNA, 1158 bp, Homo sapiens
aattcgcggccgcgtacgaccgcgagaagacgacaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagacagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281913 - DNA, 1478 bp, Homo sapiens
  misc_feature (1336)..(1336): n is a, c, g, or t
  misc_feature (1339)..(1339): n is a, c, g, or t
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttatttgggtgttcaaattgggtganccnatggtggagaacgcgggagtaattggcattggaggagagaaaattggtagcggggagagagaatggggacggggaaaaagggggggaggggcgaaaaaaagagaggaaagagggggaaaaaaaaaaagagggggtagaa

SEQ ID NO: 281914 - DNA, 956 bp, Homo sapiens
aattcgcggccgcgtacgaccgcgagaagacgacaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaaaaaaaaaaattccaggtggatc

SEQ ID NO: 281915 - DNA, 789 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataacctgatgggagcaagatggccatcttcgtcccatcagcggatttctatacattgacctcttgttggttataactgatgggagcaagagcg

SEQ ID NO: 281916 - DNA, 1390 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaaaaaaaaaaattccaggtggatc

SEQ ID NO: 281917 - DNA, 1646 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281918 - DNA, 2282 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttcgcggcggggaccatgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccggggggggcggggggggtggagagaggtcggcagatccagctctccagcttggcaacctgcttagtctttctgaatctggtatttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281919 - DNA, 1134 bp, Homo sapiens
cttgcaatatctaataaaaaaatctctcggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281920 - DNA, 1158 bp, Homo sapiens
  misc_feature (163)..(163): n is a, c, g, or t
ggaaacacactaggcaaagaatgcgtcaaaatcaggagaatcattaatgtgggtgatttagctcgagaagtctgatcatcggatatcaggagtcgaaagctctccaaggagggcacaatgattgccggggtggggttagcgccgggtgcgtggtggggggggnggggggggggggggggggggggggggggggggggggggggggggggggggggggtgggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281921 - DNA, 1131 bp, Homo sapiens
  misc_feature (989)..(989): n is a, c, g, or t
  misc_feature (992)..(992): n is a, c, g, or t
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttatttgggtgttcaaattgggtganccnatggtggagaacgcgggagtaattggcattggaggagagaaaattggtagcggggagagagaatggggacggggaaaaagggggggaggggcgaaaaaaagagaggaaagagggggaaaaaaaaaaagagggggtagaa

SEQ ID NO: 281922 - DNA, 2228 bp, Homo sapiens
cccacacagtgaacagggaatactaagctcaaatattcgtccaacgtaatcctgtaatcagtggggtgccgggttgagctcgctaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttcgcggcggggaccatgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccggggggggcggggggggtggagagaggtcggcagatccagctctccagcttggcaacctgcttagtctttctgaatctggtatttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagacagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 281923 - DNA, 477 bp, Homo sapiens
aattcgcggccgcgtacgaccgcgagaagacgacaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtggagattcggcgtgtgcagggtaccgagctcg

SEQ ID NO: 281924 - DNA, 795 bp, Homo sapiens
agggggaggtggggcgggccccactggatgtgccagggaccaggaccaggccacgctgggccagagctgtcatggttcaggccttgcacacagaaccacagaacatgctcaacaagccccctaagcttaggggcactgacctaccctggggactagtaatcttcaagatgagaaagcggaggcacagcggtgccctgatacggccaagagaagcactgtgggtaagcaggagagctaggaacagaccccagctgccctcgctggcgaatgcacagaaccattacatcatcctaccccgagacccaaccaagaggtacccacaccccgtggcagccggggctgaaggcctggagataggagaggaggccccacatactccagcacccaaggcaatgagagaaactgaggcccaggaaggtgctaggtccgtgaagaggaaggtgggaagggctgggcagtgagcttcttcagagctgaggttcttctctgccaccccctcctgtcttgcaggtctcaaaccgcgtcaggcccctcgagagctcctatggatcaacagtgtctggggagagccagagccccgggacagatgcagggctgcctaagaccctcagatggcccacctgatgcagagtcaaccattcaatctagtccaagcctgaactcttgggttctgggtctgtggggtgtccagaatcctggagtgggatgactgaggcttaggggtgcccctgcctgggctgctcagccagcaggtgtgaacaagggttcctgcctcccaagtcacagagggagaga

SEQ ID NO: 281925 - DNA, 2037 bp, Homo sapiens
agggggaggtggggcgggccccactggatgtgccagggaccaggaccaggccacgctgggccagagctgtcatggttcaggccttgcacacagaaccacagaacatgctcaacaagccccctaagcttaggggcactgacctaccctggggactagtaatcttcaagatgagaaagcggaggcacagcggtgccctgatacggccaagagaagcactgtgggtaagcaggagagctaggaacagaccccagctgccctcgctggcgaatgcacagaaccattacatcatcctaccccgagacccaaccaagaggtacccacaccccgtggcagccggggctgaaggcctggagataggagaggaggccccacatactccagcacccaaggcaatgagagaaactgaggcccaggaaggtgctaggtccgtgaagaggaaggtgggaagggctgggcagtgagcttcttcagagctgaggttcttctctgccaccccctcctgtcttgcagactcccttaagacaattgttattctccaccctgcccctcctccacccggggtcaggcctgcctgcggacaaagtagacacccgcctacaccacgcgattctgagaaacggatttacattacgagtcgcctgggaccagccacagaaccagcttctctacaagcctccacatacccacggatctttcctccgtatcccacatactgcataactgaccatcatctaagttctcaccaccatccgttgagctacacattgtccctgtcctggtcagcaagggctggaggtagaagggaagactcgtactttgtccctaacgccccaactccattgcattataatcaattaagagtatagattattcaatctctagggtagccttgaagttggaaggggtggaatggagcctcctgttaaccctgtagcagctgacctggctaagggagctcaggccctgccatctcccctgttacactaggtcactgagcaaaggagcaactgtccccagggattttcatctctggactggaggaaagaggtggctgaaatgtcccagactcaagggctcagccaagagttgaggctgccatctgccaactccataatgaagttgggtcccaagcagcgctggggcagaggctggggcaggaaggtggctgggccggtgaaagtagcccaggggacttgcatacaaggacctaggggggcccatcaatggagatgagtcctcatctgtgcccctggcttctctaccgagccacagtgagtgaggggctgagatttcagccctagcccagcagacatggctgtcccctgtagccagctccacctagtccccaaggcctgccctctgtcctcagaggcctcatctataaagcacactcagtatccctgccttacagtggaggtaaagtgccaggtcagtgatcagtaaatggtgccctctccagttccaatcagctctcagcacccatcactgtcccttgagtgggagcagggccaggaggaggtggtagaccgaaggcagcactggggagagggatgctggcacctgagggttaatgggtaatgggcgtagaggccagcccaggagaaggtacagccctgtcctccccaccgtgggactctcctggcctcctgtggacccacacagcactggcatcaggccatttcgcagaggaagaggagggctcaaagtggggcaggactccgcaagtggctgccctcattcacagggggcttcaagggtcttctactccctccctgcaactcaaagtgtggccccgggccagggcactagccgagcaggagcaggctttctgttccatccagggaacagtggcagaggcccccccggcccccggccccatgccaaccccctgctctgctgcaacctcgacatcaaatttctacccagtccccacctgatgcaaagacattcgaggcagccagcgtgcttctacatccagtttatacacagctctatacaatatacagaaacctttatatacagatatatttatagaat

SEQ ID NO: 281926 - DNA, 940 bp, Homo sapiens
gttctgtgggcttctcctgaggagatggacgattttcagagcttgcagaaagaatttgagaccaccttcaaccagagaagcctctgtggaaatgtgccgtcactggccagttgttctgtctgtctgctgtggaacccaggcccgtgagaagagcaggggaggtatagtcatttcccttgttttacggcagaggaaactgaagataaagctatgaagtgaagctggctagtggctgcctcagggttactactgatatcactggaccccttcagaaccaagcatgaatgaagcaatcctttttcccacctgcaagtgaggctctgagggattcttcagaaatcaagactttgacccactccatattatgaatgcctcagcctacaaagagcttgcctaacccaacatcaaggggtggacacgtgatgctggacttccagagcaaaaatgggtgtttgaagaacttactcccatgatgcggcagtcaaggagatgcacagtagaggatcaaaaagctgacaacttggcctcccctgggtcgcttccaggggagcgcggcttcaccgctcgaaccagctggccaagttccgtatgctcttgggccggtccccagccctctgtacagcctggcacacccggcaccaaggctcgtcccagaaggaggtgatgtggacagcgtagctccggcgccagtggaagtagcggcgatagaccgcggggttgcggtcgaggaaaagcaggtacgaggccagggaggaggcacttgggaagtcgtccacgtggatgaaggcgccgcggggcacaaagcgctcgtagttggcacggtctgggcccagcaccaccggcaccgccccagcgagcaacgcgttgcgccagagcttctcggtgatataatccaggtgctgcgagttctcgaaagccaggtagaacttgtagcgggcca

SEQ ID NO: 281927 - DNA, 879 bp, Homo sapiens
aggcggagggagccgcgggcgccaggcgcgggtgaggcagcgactccccctccagccgcgggccccgagcgtcgcccccgccccccacgtggccgccgccgtcccagcccctccgaggaagcggcgcggcttcctgcagcttgggctggggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctccttctgctgggcgctgtcctgaatccccacgaggccctggctcagcctcttcccaccacaggcacaccagggtcagaaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaacttttttttttttttttttttttttttttttggtattggttaattgggggtttttgggctttgggcccca

SEQ ID NO: 281928 - DNA, 674 bp, Homo sapiens
gaatgagtagtggtgttgagaagctcgtggccctaggcctgggctcactgtctttactcctccatagggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaacttttttttttttttttttttttttttttttggtattggttaattgggggtttttgggctttgggcccca

SEQ ID NO: 281929 - DNA, 934 bp, Homo sapiens
aggcggagggagccgcgggcgccaggcgcgggtgaggcagcgactccccctccagccgcgggccccgagcgtcgcccccgccccccacgtggccgccgccgtcccagcccctccgaggaagcggcgcggcttcctgcagcttgggctggggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctccttctgctgggcgctgtcctgaatccccacgaggccctggctcagcctcttcccaccacaggcacaccagggtcagaaggggggacggtgaagaactatgagacagctgtccaattttgctggaatcattataaggatcaaatggatcctatcgattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaacttttttttttttttttttttttttttttttggtattggttaattgggggtttttgggctttgggcccca

SEQ ID NO: 281930 - DNA, 988 bp, Homo sapiens
aggcggagggagccgcgggcgccaggcgcgggtgaggcagcgactccccctccagccgcgggccccgagcgtcgcccccgccccccacgtggccgccgccgtcccagcccctccgaggaagcggcgcggcttcctgcagcttgggctggggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctccttctgctgggcgctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaacttttttttttttttttttttttttttttttggtattggttaattgggggtttttgggctttgggcccca

SEQ ID NO: 281931 - DNA, 1127 bp, Homo sapiens
cgggcgggaggcgcgagaggccccggaggggagaggggagaggggagaggggctggatggccgaggccggaacgggccctggggtgcgggttaggaccgacgtacctagcagcactggccctcggacggtccctgaccccacctcggggcgggcgcagcatgagctgcttcccacccagggaaagctggggtgctggccccggcccctcgaagagggcttaggaggacggaagctggccagagatgagggggctttgggcctgggtgtgagtgacaaggagctggtgccagcccctccctccccggcactgaggcgtccgtgggggctagattattcctccttttcttccaaggtagcctattttcggagggtctcagtcccccaacccccctcgcaggctccactgccggggtccccgctatgttaccctcctctcccgtttcttcccacagctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaacttttttttttttttttttttttttttttttggtattggttaattgggggtttttgggctttgggcccca

SEQ ID NO: 281932 - DNA, 801 bp, Homo sapiens
aggcggagggagccgcgggcgccaggcgcgggtgaggcagcgactccccctccagccgcgggccccgagcgtcgcccccgccccccacgtggccgccgccgtcccagcccctccgaggaagcggcgcggcttcctgcagcttgggctggggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctccttctgctgggcgctgtcctgaatccccacgaggccctggctcagcctcttcccaccacaggcacaccagggtcagaaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttatactcccttttctcactctcatccccaccacagatccctggattgctgggaatggaagccaggtggggtcatggcacaagttctgtaatcttcaaaataaaactttttttttttttttttttttttttttttttt

SEQ ID NO: 281933 - DNA, 484 bp, Homo sapiens
ttcggcagaggccgcatatttataaggtggacccaatgcctctggagccacggtaagggcaaaggagagccatgatctgacttatgttttaagatactctggcttctgggttcagaaaagactgaaggggcaagagaggaagcaggtggagaccagagcggcagtgattgccatcatccagactcagactaggacaatagctgtgagagtgatgggaagtggttggatcctgactgtattttaatagcagaattgacaggatttgctgatagactgcacgtggggtgggagagggtcaagatgacttcaaggttctcatctgagtcaagattccagcccaggcagcctagacctgagagcacgctcctaaccactgcacatcactgtcttagcacctcctcagcacaaactggcccttgaggaatgaaataccgccgccggacacacgctcctgagttaagcctttgtcaatgaaatgaacacc

SEQ ID NO: 281934 - DNA, 357 bp, Homo sapiens
gtctcactctgtcacccaggctgatatgcagtggtgaaatctcggctcactgcaacctccaactccgaggttcaagcaattctcctgcctcagcttcccgaatagatgggattacaggcacgtgccatcacacctggctaattattttgtattcttagtacagggtttcaccatgttggctaggctggtctcaaactcctggcctcaagaaatcggcccacctcagcctcccaaagtgctaggattacaggcgtgagccactgcacccagcctctagcaccatttattaaaaagaatattcttttcctcattgaatcgacttggcactcttgtcaaaataaattgactatacagtaa

SEQ ID NO: 281935 - DNA, 385 bp, Homo sapiens
ggtcaaggaaaaccaaaagcagccaggggtgggcccacgccacaggccaggccccatgccaagtgtgctggccaccattccctcccgtctcctcactgtggaccagcatggaatagcgtcaccctggtcagcagcagaggctcagaaaggaaaagggatctgcctgaagctactcagccaaacagagccagggtttcaccatgttggctaggctggtctcaaactcctggcctcaagaaatcggcccacctcagcctcccaaagtgctaggattacaggcgtgagccactgcacccagcctctagcaccatttattaaaaagaatattcttttcctcattgaatcgacttggcactcttgtcaaaataaattgactatacagtaa

SEQ ID NO: 281936 - DNA, 2219 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281937 - DNA, 1725 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagaggttaggggaaggccggagaatgggctgggaggctgcgtttcggagcttagggttctgtccctgcgatcgccgcgtctccctcccttggtgggcgcggctcccgggaagcggctcgtctcgtctcccctcacaggccgggttcccgttctggaccttcgccctcggaacacagtgctgttggccgggactccttcccgaggtggacggctccctgttcttattcctggctctgccagaactgtaggaagtgctcagtacactttagggcatgcatggcactccctgggagacagtgctttagggccagaggaaagatcttccctgaaggcaaacgcccgcggagcccacaagtccgggccgcactgaacaagtcaggatgttgccatcggcaattctgcagaaggcagtaacccatctgagagaaagagccgctgtcataaggtctcttgcttgagctgctgggttgagaatggagctggaagagggaactgatctcggagctccttggggatcttggttatgtttgacccttttactttcagggtggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281938 - DNA, 2107 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtcttgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281939 - DNA, 2132 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtcttgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281940 - DNA, 2573 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagaggttaggggaaggccggagaatgggctgggaggctgcgtttcggagcttagggttctgtccctgcgatcgccgcgtctccctcccttggtgggcgcggctcccgggaagcggctcgtctcgtctcccctcacaggccgggttcccgttctggaccttcgccctcggaacacagtgctgttggccgggactccttcccgaggtggacggctccctgttcttattcctggctctgccagaactgtaggaagtgctcagtacactttagggcatgcatggcactccctgggagacagtgctttagggccagaggaaagatcttccctgaaggcaaacgcccgcggagcccacaagtccgggccgcactgaacaagtcaggatgttgccatcggcaattctgcagaaggcagtaacccatctgagagaaagagccgctgtcataagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtcttgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281941 - DNA, 3070 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagaggttaggggaaggccggagaatgggctgggaggctgcgtttcggagcttagggttctgtccctgcgatcgccgcgtctccctcccttggtgggcgcggctcccgggaagcggctcgtctcgtctcccctcacaggccgggttcccgttctggaccttcgccctcggaacacagtgctgttggccgggactccttcccgaggtggacggctccctgttcttattcctggctctgccagaactgtaggaagtgctcagtacactttagggcatgcatggcactccctgggagacagtgctttagggccagaggaaagatcttccctgaaggcaaacgcccgcggagcccacaagtccgggccgcactgaacaagtcaggatgttgccatcggcaattctgcagaaggcagtaacccatctgagagaaagagccgctgtcataaggtctcttgcttgagctgctgggttgagaatggagctggaagagggaactgatctcggagctccttggggatcttggttatgtttgacccttttactttcagggggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcaggtaagaaaggaccagaagttccggttctaccatagcaaggacctaagttgctaatttaggttctttaatgcagacctggtctttcagaacttctttctcttccctagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281942 - DNA, 2340 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtcttgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281943 - DNA, 2365 bp, Homo sapiens
gggccgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtcttgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtctt

SEQ ID NO: 281944 - DNA, 2726 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281945 - DNA, 2640 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281946 - DNA, 2602 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccagggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281947 - DNA, 2200 bp, Homo sapiens
atccaaggctcctcgtccgcagcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281948 - DNA, 1824 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281949 - DNA, 2537 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281950 - DNA, 1897 bp, Homo sapiens
gcagatggctcagcagaggccttgcagatctgcaaggcacaggaataggaatgcttgtggtagtgtgagggagagggccccagtgtcatccaccatggagggcgagctggaggctccagcccatggaagcaccaaagccatatgcactcctgggtgacctggggccgcaatgccctcgtcatttgtacagtgtcttacggtttataaagagctttcccagccatcttttatttgtacaatttccctgagaggctactatcctcccttgagagatgaagaaactgaggcccagccaggtaagacagcaggatcaaggtcgcagagctggggctcagacagagacttctgactccagttggtgcaccttccgaagtaccatggctgtcagtcaccttctgacctttttgggcctcagtttctccatctgtaagagtggaggaacagggctcagactggatgccctgagttttgtcgacattggggtttcctgcaggaggtggggcaggtggtgagtgctgagggctgttgagggcccgcgctgactgtgctgtggctgcaggctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggtagggctgcagcactgatgcccaggtgtcttttgggtctctcggcagcggttctcagggtgtagaggaagctgggagccttctctccctgagggtcctctgttgttacctgtgccagggaccgttgtgggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281951 - DNA, 1700 bp, Homo sapiens
atccaaggctcctcgtccgcagcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281952 - DNA, 642 bp, Homo sapiens
ataagtcggtacctcgctattcatctggcacctgtaccggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281953 - DNA, 372 bp, Homo sapiens
gagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctggtaagggtctgctccctcttctgtggggccagtggagggggcggatgttgcaaatcctgggttggagtc

SEQ ID NO: 281954 - DNA, 2854 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggtagggctgcagcactgatgcccaggtgtcttttgggtctctcggcagcggttctcagggtgtagaggaagctgggagccttctctccctgagggtcctctgttgttacctgtgccagggaccgttgtgggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281955 - DNA, 2730 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggtagggctgcagcactgatgcccaggtgtcttttgggtctctcggcagcggttctcagggtgtagaggaagctgggagccttctctccctgagggtcctctgttgttacctgtgccagggaccgttgtgggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccagggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281956 - DNA, 2735 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggtagggctgcagcactgatgcccaggtgtcttttgggtctctcggcagcggttctcagggtgtagaggaagctgggagccttctctccctgagggtcctctgttgttacctgtgccagggaccgttgtgggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281957 - DNA, 2016 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccagcggacctggtgaatgactggggaacaaggctaccaggataggcaaatcctctacggaggagcagtggcaacaccagaatgtgggcacaaccggagaacggcccaagacagaacagaaaaccaag

SEQ ID NO: 281958 - DNA, 2053 bp, Homo sapiens
atccaaggctcctcgtccgcagcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281959 - DNA, 2580 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttcggttctcagggtgtagaggaagctgggagccttctctccctgagggtcctctgttgttacctgtgccagggaccgttgtgggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggtgggcatacgcatgtctgccacctccttagtagccgtggcaccttggccccagctggcctgggccctgtcccactacccctttggcgtgactgcagactggcaccagcccctgccttcccacaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281960 - DNA, 2226 bp, Homo sapiens
gggcccgcgcgggggattcggggctccgcgggttcaggcccgggggcggggcccgggggccatcttggctatgggcggaagttttcttcagagaccgagggacgggaatccgttgccgcccccggccgggcggcacgaccccgatttgggtataggagagacgagcgtgggaactggcggacccccatacaagtaaaggcgggcggcacggggcacggcccacccggggaccccctggatgcggcacggcccccgcaactcggccgcccgcctgccgcctcccgtaaccccgggcgcccgccagcggcgcagctcgcgccaattctcgtacggtttcacgccgggtgcggcgctggactgcggagccagccgggccgctgcgcaatttgcgtagcgaacggcgcccgcgcaggcgcggagggggaggggggcggagcagcgggagccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281961 - DNA, 748 bp, Homo sapiens
ataagtcggtacctcgctattcatctggcacctgtaccggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacaaaa

SEQ ID NO: 281962 - DNA, 1532 bp, Homo sapiens
  misc_feature (1)..(1): n is a, c, g, or t
  misc_feature (1124)..(1124): n is a, c, g, or t
  misc_feature (1277)..(1277): n is a, c, g, or t
  misc_feature (1289)..(1290): n is a, c, g, or t
  misc_feature (1337)..(1337): n is a, c, g, or t
  misc_feature (1342)..(1342): n is a, c, g, or t
  misc_feature (1368)..(1368): n is a, c, g, or t
  misc_feature (1371)..(1371): n is a, c, g, or t
  misc_feature (1377)..(1377): n is a, c, g, or t
  misc_feature (1432)..(1432): n is a, c, g, or t
  misc_feature (1445)..(1445): n is a, c, g, or t
  misc_feature (1519)..(1519): n is a, c, g, or t
ngaccaatgaaagcgcagatttattgaggggaaagtacactccacagaagtggaatgtaggtgtgggagcaggcgaccaagcggctcaagaaccccgattacaatgttttttagggttttattaggttggtgcaaaagtaattgcggtttttgccatgaataagctagaattttataataccccaagagttctttaaaggcctccaatcctatgaaggactggtgcacaaccaatcagaggctgaagtggagacttctgtcttgttaccacaggagtgaggacgtggcctgtgtgctgcctcatcttgcctagaactagctgcacctgctgttcttttgcttatgccttcattcttggttaccctaattccctattctcctgcctcactctgaggcattagagttggtttttcagtctgccagggacaaaagagaactaatccagataggaccatgccaaggaagatagaggagaggctaaagaaagagtacaaaggtcaatcagtcgttcccatggaaaaacaactctcctgcttatatagtcaattattgtgtccaattcattcagcaaaacatttattcatgtaatatcccttacttggtattctaacttatattttcaactcattttaggaacttgaagtcagtctcaggtaaagaacaatgaaagagaaatctcagcttggtattggtaatggtggtgataatctccacctggagacactaggcgtatgttaaattatcgagcttgttatctttcctgggaagtgattatcatttgtttctcttgtgacagcggggagtgttctgcatgaggaactaatatgataccagaaaaacaggtgaaatgccagttacagaaacttattaccaacgactatctaataactgcgatgacagaaataggtcaattgaaacatgagtggatggtgaaaaaaatttacacttcacagaagtttttctttctttttttttttttttttttttgagacaaagtctcgttctgtcccagactggacactattcacaatagccaaaatatggaatcaacctagatgtccaacaacagataaatggataaagaaaatgtggtttatacacacaaaggaatactattcaaagancagaatgaaatcctatcacctgaggcaacatggatggaaatggaggacattatttaagtgaaataagccaggaacataaacatgcacattcccactcatatgtggaagctttaaaaaaaaaaaaaaaagctgggtgcggtggctcacgcctgnaatcccagcacnntgggaggctgaggcgggtggatcacctgaggtcgggagttcaagacnagccngaccaacatggagaaaccctgtctcnacnaaaaanacaaaattagccggggtggtggtgcatgcctgtaatcccagctactcaggaggcngaggcaggagaancgcttgaacccaggaggcagaggctgcggtgagccaagatcatgccactgcactccagcctgggcaaaaagagngaaactccatctc

SEQ ID NO: 281963 - DNA, 331 bp, Homo sapiens
tgacagcggggagtgttctgcatgaggaactaatatgataccagaaaaacaggtgaaatgccagttacagaaacttattaccaacgactatctaataactgcgatgacagaaataggtcaattgaaacatgagtggatggtgaaaaaaatttacacttcacagaagtttttctttctttttttttttttttttttttgagacaaagtctcgttctgtcccagactggagtgcagtggcgccatcttggctcactgcaacctccacctcccgggttcaagcgattctcctgcctcagtctcccaagtagctgggataacagatgcctgccac

SEQ ID NO: 281964 - DNA, 464 bp, Homo sapiens
agacagggtctcactgcatcacccaggctggagtgcaatggtgcaatgacagatcactgcagccccaacctgttgggctcaagtgatcctcccacttcagcctctcgagtagatgggactacgggcagccaccaccattcccacctaatatttctattttatttttgtagagatggggtctatgttgctgaggctggtcttgaacttctggactcaagagatcctcctgcctctatctcccgaagtgttggtattacaggtgtgagccaccacgccatttttcttttttttgagacagggtctggctctgtcaccaaggctggatgatttagcctagataatagtcaagtactgatgcattcattacaaaaagacacaagtatctgacagaatacccaagcttggagtagtattatgtatgaatacttaatacttaaggatatggttccacactctaccaagag

SEQ ID NO: 281965 - DNA, 436 bp, Homo sapiens
ttgtagagacagggtcttgttatgttgcccaggctagtctcaaacacctggcctcaactgatcctcccacctcagcttctgaaggtgctgggattacaggcatgagccaccacaagaacaacacatttctataaggttatggggttttacttttttccagtgttaattagtttcacatatctagaatttgtaatttcttattggatactagaattactgtatttatttacctgaacaaattaatgtttccctctacaaactactttagaaagattttcaataaaggtaaatgggatgtaataatctattaagaaaaaatgactcagagtggaacctgtagccaaaatataaatttgctgtatttaagagtaattgaaagcaaaagattcccaaaagcttgaaaaaaatggagatgccctaaataaacttaccattg

SEQ ID NO: 281966 - DNA, 359 bp, Homo sapiens
ggctcgtcccttcccccacccccagccgccgccgccgcccgcgcttcgcaacaaagccggctgcggagccatggtccacgccgcccgcccgcgaccccgccgccccgcatggtagccggaacgtctctcccttaccagccttcgcttcctggtgcccagctcttaggaccgtgtgtgactctggccttctaccgagacaacagagaaacgcacagcaactcgcatggaggaatcggcgaaatggctccgaccgcggcgctagggggcggggccagcgagcgtacgcatgcgcagagcgcgtgccagggcgggggatggcgagggcgcgccaatggagggggcggggctcagcaacctcg

SEQ ID NO: 281967 - DNA, 1542 bp, Homo sapiens
ggctcgtcccttcccccacccccagccgccgccgccgcccgcgcttcgcaacaaagccggctgcggagccatggtccacgccgcccgcccgcgaccccgccgccccgcatggtagccggaacgtctctcccttaccagccttcgcttcctggtgcccagctcttaggaccgtgtgtgactctggccttctaccgagacaacagagaaacgcacagcaactcgcatggaggaatcggcgaaatggctccgaccgcggcgctagggggcggggccagcgagcggtgttgaaagcagcaggggcctagaagacattaaaccgataccacagaaatacaaaggatcattagagactattatgaacaactatatgccaacaaattggaaaccaaatggaaatggataaattcctgaacagatacaacttaccaaaattggaccaagaagaaatagaaaacctgaaaagaccaactatgagtaatgagattaaatcagtaatatagagtctcccatcaaagaaaagtccaggccctgatggcttcactgctgaattctactgaacagttaaagaagaactcataccagttctcaaactcatcctgtgagggcagcattaccctgataccaaaactagatatggacacaagaaaaaaaatctataggccagtatccctgatgaacatagatgcaagaatcctcaacaagaccaggtgtggtggttcatgcctgtaatcccagcactttgggaggccaaggcaggtggatcacctgaggtcaggaatttgagaccagcctggccaacatggcaaaaccctgtctgtactaaaaatacaaaaattagccgggcaaggtggcgtgtgcctgtaatcctagctacttgggaggctgaggcaggagaattgcttgaacctggagggaggaggggcagaagttgcagcgagctcagatcgtcccactgcactccagcctgggtgacagagtgagactccatctcaaaataagtaaataaataaagagactcaactagcataaatgaattgcaagtgttttatagtatataatgagcacaacaaaagtatcaatatattacatggaaatacatttttcaaagctggatctttagcttccaaggattaaggagaattttgttactgagttggttcttaatttaggctctgcacctgagacctagagtcccctgggatttgggtccgaggactggcattacctttgtaggtggctcttggcaactagcactgtctaagatcttaacatttgcaaatgaagccttaaaacatgtcccaaaagtatggaaagtgggccgatttcaacacaaccattacctgttcctggtagctgaccaactaggagatttcagaggtcaagtgggacagagcagggtagggaatttttttttaagctttattataaaacaggtaactttgtccctatcttaagaatttggaactgaggctataggtcactcaatgatcaaataatgaaaggtctgcttcaactggactacttaatatttcacatttacct

SEQ ID NO: 281968 - DNA, 1452 bp, Homo sapiens
agacagggtctcactgcatcacccaggctggagtgcaatggtgcaatgacagatcactgcagccccaacctgttgggctcaagtgatcctcccacttcagcctctcgagtagatgggactacgggcagccaccaccattcccacctaatatttctattttatttttgtagagatggggtctatgttgctgaggctggtcttgaacttctggactcaagagatcctcctgcctctatctcccgaagtgttggtattacagggtgttgaaagcagcaggggcctagaagacattaaaccgataccacagaaatacaaaggatcattagagactattatgaacaactatatgccaacaaattggaaaccaaatggaaatggataaattcctgaacagatacaacttaccaaaattggaccaagaagaaatagaaaacctgaaaagaccaactatgagtaatgagattaaatcagtaatatagagtctcccatcaaagaaaagtccaggccctgatggcttcactgctgaattctactgaacagttaaagaagaactcataccagttctcaaactcatcctgtgagggcagcattaccctgataccaaaactagatatggacacaagaaaaaaaatctataggccagtatccctgatgaacatagatgcaagaatcctcaacaagaccaggtgtggtggttcatgcctgtaatcccagcactttgggaggccaaggcaggtggatcacctgaggtcaggaatttgagaccagcctggccaacatggcaaaaccctgtctgtactaaaaatacaaaaattagccgggcaaggtggcgtgtgcctgtaatcctagctacttgggaggctgaggcaggagaattgcttgaacctggagggaggaggggcagaagttgcagcgagctcagatcgtcccactgcactccagcctgggtgacagagtgagactccatctcaaaataagtaaataaataaagagactcaactagcataaatgaattgcaagtgttttatagtatataatgagcacaacaaaagtatcaatatattacatggaaatacatttttcaaagctggatctttagcttccaaggattaaaggcatgagccaccacaagaacaacacatttctataaggttatggggttttacttttttccagtgttaattagtttcacatatctagaatttgtaatttcttattggatactagaattactgtatttatttacctgaacaaattaatgtttccctctacaaactactttagaaagattttcaataaaggtaaatgggatgtaataatctattaagaaaaaatgactcagagtggaacctgtagccaaaatataaatttgctgtatttaagagtaattgaaagcaaaagattcccaaaagcttgaaaaaaatggagatgccctaaataaacttaccattg

SEQ ID NO: 281969 - DNA, 1215 bp, Homo sapiens
tttttttttttgtacccttcagggtgttgaaagcagcaggggcctagaagacattaaaccgataccacagaaatacaaaggatcattagagactattatgaacaactatatgccaacaaattggaaaccaaatggaaatggataaattcctgaacagatacaacttaccaaaattggaccaagaagaaatagaaaacctgaaaagaccaactatgagtaatgagattaaatcagtaatatagagtctcccatcaaagaaaagtccaggccctgatggcttcactgctgaattctactgaacagttaaagaagaactcataccagttctcaaactcatcctgtgagggcagcattaccctgataccaaaactagatatggacacaagaaaaaaaatctataggccagtatccctgatgaacatagatgcaagaatcctcaacaagaccaggtgtggtggttcatgcctgtaatcccagcactttgggaggccaaggcaggtggatcacctgaggtcaggaatttgagaccagcctggccaacatggcaaaaccctgtctgtactaaaaatacaaaaattagccgggcaaggtggcgtgtgcctgtaatcctagctacttgggaggctgaggcaggagaattgcttgaacctggagggaggaggggcagaagttgcagcgagctcagatcgtcccactgcactccagcctgggtgacagagtgagactccatctcaaaataagtaaataaataaagagactcaactagcataaatgaattgcaagtgttttatagtatataatgagcacaacaaaagtatcaatatattacatggaaatacatttttcaaagctggatctttagcttccaaggattaaaggcatgagccaccacaagaacaacacatttctataaggttatggggttttacttttttccagtgttaattagtttcacatatctagaatttgtaatttcttattggatactagaattactgtatttatttacctgaacaaattaatgtttccctctacaaactactttagaaagattttcaataaaggtaaatgggatgtaataatctattaagaaaaaatgactcagagtggaacctgtagccaaaatataaatttgctgtatttaagagtaattgaaagcaaaagattcccaaaagcttgaaaaaaatggagatgccctaaataaacttaccattg

SEQ ID NO: 281970 - DNA, 1473 bp, Homo sapiens
ggctcgtcccttcccccacccccagccgccgccgccgcccgcgcttcgcaacaaagccggctgcggagccatggtccacgccgcccgcccgcgaccccgccgccccgcatggtagccggaacgtctctcccttaccagccttcgcttcctggtgcccagctcttaggaccgtgtgtgactctggccttctaccgagacaacagagaaacgcacagcaactcgcatggaggaatcggcgaaatggctccgaccgcggcgctagggggcggggccagcgagcggtgttgaaagcagcaggggcctagaagacattaaaccgataccacagaaatacaaaggatcattagagactattatgaacaactatatgccaacaaattggaaaccaaatggaaatggataaattcctgaacagatacaacttaccaaaattggaccaagaagaaatagaaaacctgaaaagaccaactatgagtaatgagattaaatcagtaatatagagtctcccatcaaagaaaagtccaggccctgatggcttcactgctgaattctactgaacagttaaagaagaactcataccagttctcaaactcatcctgtgagggcagcattaccctgataccaaaactagatatggacacaagaaaaaaaatctataggccagtatccctgatgaacatagatgcaagaatcctcaacaagaccaggtgtggtggttcatgcctgtaatcccagcactttgggaggccaaggcaggtggatcacctgaggtcaggaatttgagaccagcctggccaacatggcaaaaccctgtctgtactaaaaatacaaaaattagccgggcaaggtggcgtgtgcctgtaatcctagctacttgggaggctgaggcaggagaattgcttgaacctggagggaggaggggcagaagttgcagcgagctcagatcgtcccactgcactccagcctgggtgacagagtgagactccatctcaaaataagtaaataaataaagagactcaactagcataaatgaattgcaagtgttttatagtatataatgagcacaacaaaagtatcaatatattacatggaaatacatttttcaaagctggatctttagcttccaaggattaaaggcatgagccaccacaagaacaacacatttctataaggttatggggttttacttttttccagtgttaattagtttcacatatctagaatttgtaatttcttattggatactagaattactgtatttatttacctgaacaaattaatgtttccctctacaaactactttagaaagattttcaataaaggtaaatgggatgtaataatctattaagaaaaaatgactcagagtggaacctgtagccaaaatataaatttgctgtatttaagagtaattgaaagcaaaagattcccaaaagcttgaaaaaaatggagatgccctaaataaacttaccattg

SEQ ID NO: 281971 - DNA, 344 bp, Homo sapiens
tgccgcctccaccacccaggcgagtaggcagtgggctccgagggcttggggctgcagcatcctggacagactcaccgaaaacactctctcttcactgtctcactataaataccctaggttatgagactggggaaggttcagttagccacattttctttactgagaaactatggccatttacctaaggtgccgcagttgggccagggggaaaaacaaggattaaactctgtgttccttccaccagacctcactaaaaaaggaaaaggaaaacagaggctttctcattgtctcgaaagtgtagccctccccagtctataaagttacatgttccgagtactaaaaag

SEQ ID NO: 281972 - DNA, 587 bp, Homo sapiens
cctgcaatgtgcactggatctggggggcgacagaaagtgacagtcaagatctatgtgagatgggctggacagagacaatgtgcagaggcgccacctaatacgccggcaaagcctgtgccagctagctcatgaagggctgtgatatggtttggcaatgtgtccccatccaaatctcatgttaaattgtgatccccagagttggaggtggggcctggtgggaggtgattggatcattggggtagttttgaatggtttagccccagccccctagtgctgtcttgtgatagagttctcatgagatgtggttgtttgaaagtgtgtagcacctccctcttcacactctctctctcctatcagccatgtgaagatgtacctgcttcccctttgccttccgccatgactgtaggtttcctgaggcctccccagaagcagaagcctgtacagcccacaaaaccatgtgcagattaaacttcttttctttataaattatccggtctcaggtagttctttatagcagtgcgagaacagactaatacaggctatcagaccttgaactggctgacatttgaaagcaaactctgaacttt

SEQ ID NO: 281973 - DNA, 420 bp, Homo sapiens
gggggggggagaaaaagaaagaaaaaaaataggttataatgtcctgtgtttccttttttaatgaatggggagaaggtaaggaacaaaactatcaacttaagtttacaggtaagtatcaaaaattaatcctcatgctaaatgctcacatttatgtcttctgccaggaacagcacattggtaatattctgtactggcctgaggtgactagagtaaaaccgtagtgtgctgccctgctctacaattgcctaagcccacagatgtaactcatcccaactaaacacagagagaccagggagtttgccgattcctcagacacagatcgctgaagagttggaattagctgtttgctgttatccacttctgcttcagcatcctcttctgcagattgttctttgatttctgcttaacagtaaacaagag

SEQ ID NO: 281974 - DNA, 748 bp, Homo sapiens
gagtttgatttctgttattttataatatatcagaaatagtcacattggaggaaatcagaactgtttgggacttcttttaattctttcatgggttgacattgttattttgatttctatgtagacaaaccaagcttaaggcctattaacaatactaagaaggccttgatattagatagagaagaaaagtatatttatgcaaataccagccttggttttggtactaaactgggtaacatgtgggtgtctgttttcccatgagttaggtttgcctagggcttccttccagtttaatgtttcatgattccaatcatttcttccctgtcttcatgcatggttctccaatggtaccttccttccctggaggaatctttgccaagaagacttctgctatagctaccaacatagctgtgccacctgattccatggattggcatctccatcacctaatgaagcagagataacacggaggacctcagtcaatactatctacaaacctcagttgatatcatttgcaaacctccctgattcagtattaacattcacaatatttaattaggcaccattgaatttcatttaccaaatgtcaagcagatgacaaaattctcccaatttgataaaatttgataaattttaatgttgacattaagtcacttttattttagaaaacagcaagacatcttagattttgaaaacggaaaagtcaatatcaccaaagtctgtttgttggtataagataaaaaattgagtt

SEQ ID NO: 281975 - DNA, 727 bp, Homo sapiens
aagcagacctcaggcggtaatgctgactggcccgaagctcacctcctgctgtgttgcccggttcctaacaggccatggacctgcaccagtctgtggcccgaaggctggggacccctgattcctacacgaagaaacctcaaacccaggattcaagccaaaaacaatgattctcaagttcctatgaaatcctggatggatgttgaactgggcaacgtactagctgactcccgtggcagatgcgagcctcaacaaagctccagggctggcacttcaagggagcggaggtgtgtgtttgagtctgagtcacatgcagtaggccatctgctcttatcaacaggatgagaatctttgccaagaagacttctgctatagctaccaacatagctgtgccacctgattccatggattggcatctccatcacctaatgaagcagagataacacggaggacctcagtcaatactatctacaaacctcagttgatatcatttgcaaacctccctgattcagtattaacattcacaatatttaattaggcaccattgaatttcatttaccaaatgtcaagcagatgacaaaattctcccaatttgataaaatttgataaattttaatgttgacattaagtcacttttattttagaaaacagcaagacatcttagattttgaaaacggaaaagtcaatatcaccaaagtctgtttgttggtataagataaaaaattgagtt

SEQ ID NO: 281976 - DNA, 390 bp, Homo sapiens
taccttgggagcctcaatggcagtatatgtggctcctggaggaacttggtagccctcagtatacaacttaaagtgatgaatcagtgactccatggaagtctgaagagaggaaacagggagcatcaataaaccatatccaaactctgtctcctaggcctcccccagcacagaaaataatctctaccctcagggagactaaagccacatgtcagtcagtaagcagagaggatacagaataaaacaggagagctatgggagattaagaatctcttatatggccgggtgcggtgactcacgcttgtaattccagcactttgggaggctgaggaacgagactcgcttgaacctgggaggtggagtttgcagtgagccaagatcacactattgcac

SEQ ID NO: 281977 - DNA, 1384 bp, Homo sapiens
  misc_feature (1147)..(1147): n is a, c, g, or t
cctttgcttttagccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgataccagtccttgantttgtccctggaatatgaagtgaagtaagaaatggcgtctgttcttagcataccatggtgcatcactcaagttactcttcaagttaccactttatgtgttttccaaaaactaaagacttttctaaatgaaagaaagcactcgaaaacctataattatgatttccaagaatttttgactacagtttaagacatatccttcattttgaaagaaaaataaataactggatttttactgtt

SEQ ID NO: 281978 - DNA, 531 bp, Homo sapiens
gtatttttgtttcataaatgaagtaaaggaggtaaataaacctgagtaaatggcagaaccaagacccaccagtcttagctattacaacattgtaattgctatgttgcatttttttccaaagcagagacaaaaaacactgaattattgaaccctgtgataaacaatgcagttagcaggaagttaggagtatgatacaacttatcaagaagaaataatcacaacaggcagatcttctgttaatctttacttttgagtaagactatagtaaggtatttctttataaatatttgcatcatacttatgtaaccatcctgtagacaattaataaataaaatgaaagttttctacttagtggtttgcctaaggatgttatgatagttctaacatcattgtcttgctctattagggattaacaggacctgatggatcccctggctccattgggtcaaagggacaaaaaggagaacctggtgtgcctggatcgcgtggatttccagtaagtaaatgtaaagctacagaattgaaaatttc

SEQ ID NO: 281979 - DNA, 4761 bp, Homo sapiens
cctttgcttttagccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 281980 - DNA, 4002 bp, Homo sapiens
gcaaccgctactcccgggggtgctttttctgcagggacgaagtgccacctatgctagtggcgggtctggaagcctagaggggaaccaggctgcagagccgggccaagggattagcggcgggcggcgggcatggcctggactgcgcgggaccgcggggccctggggctgctgctgttggggctctgcttgtgcgcggctcaaagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 281981 - DNA, 3496 bp, Homo sapiens
ccctggcccccaggacccagaggggccaggtggtcctcttctcccaggtcaccaacaggtcctacacggccccctggccccccaggacccagaggaacaatggctttcacaatggatctccatgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 281982 - DNA, 391 bp, Homo sapiens
cgggcctggacgctttggcaaccgctactcccgggggtgctttttctgcagggacgaagtgccacctatgctagtggcgggtctggaagcctagaggggaaccaggctgcagagccgggccaagggattagcggcgggcggcgggcatggcctggactgcgcgggaccgcggggccctggggctgctgctgttggggctctgcttgtgcgcggctcaagtaagttgcgatcgagtttgaggggtgcttttctcactttctccccatcttttcttctccagcccagccagaccaccgacgaggtaagttgggggcagggagtgtttgcatttttcaagcgcacacgaggacaggtcggggcgcagcggtcgagggagctgtgagaaaggcgc

SEQ ID NO: 281983 - DNA, 3695 bp, Homo sapiens
cctttgcttttagccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttctta

SEQ ID NO: 281984 - DNA, 3588 bp, Homo sapiens
aaaatcatgttacatgtaaccaggttacatgccatgaaggaagtgggaatgatagtgtaagttctacatacaagttaaaaggtaagtcaaacatattatcacaatttctcttatgctggtatttactttttttgtcataagtgattttgtcaactccagttttgtgtaagacttcagaattttataaaaaggtttaccatcagaagaattctccttggactttctaaactagaaatgtttgtctatatatatatagttactatttcttggtattacctttggttatgataatatccattgtctagatcagcttttgtgatgagatttttaaaaatctttgcttcaactaaaataattcacttctctttttcacatttccagggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 281985 - DNA, 3248 bp, Homo sapiens
cgtctataatgcaaaggctgggttctgctcttgtaatgcaaggtgaatgataaattcaaggtctttttcaggtcttcaaaatctcttcttctctgggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 281986 - DNA, 1585 bp, Homo sapiens
cgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281987 - DNA, 498 bp, Homo sapiens
gcacagagagccagtcggcagcttagccagtgactgctgggcctttgtttgggccccttgccctgcacacagctgatgatgagacaccccagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281988 - DNA, 455 bp, Homo sapiens
  misc_feature (83)..(83): n is a, c, g, or t
aagtgatatccacatctcacttccaaaatgatgggggatagagactactagtgaaaataaaaattgatatagacagttttagnatactccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281989 - DNA, 2524 bp, Homo sapiens
  misc_feature (1038)..(1038): n is a, c, g, or t
atcggctctgccctggtctgggtgccccacggtgatgtttgtggcagagggtctcagagaagggagcaaagcagaatgtgggcctgtgtggctccggtcctcggtttcctaactgttggcagggatcctaaaggcgccaggtcctccctgtcctcctcagctgactctgccctcctcagtgtgtccacgggcacaggctttcctcctggcaggtggcagccggagacctcctgggtgtcctgccgccactgtggacctcacctcagtgctgtctggggccttcccagaccagtcccctcccagcgggacccaacccccgccagcctcagctttcaggagctgcccccgcggcgcgaacaatatcctttctatttggagttgactctgctgccctttggagatcccagcgcgtaacgtgagctcgcgaccagcgcgggggaggcgcccacacgcccgtcccgtcttggtgtctggccccaggcggccgcgcctcccctccgaggtggtcccatagcccctgcaccaggcggcccgcgcccgcgacctcaaggcggctgccccgcgccatggcggcccggctgggtgcgctggccgcgtcggggctgtaccggcggcgccagcaccggcagagcccgccgccagccacggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281990 - DNA, 1668 bp, Homo sapiens
  misc_feature (182)..(182): n is a, c, g, or t
ggagttcctcatggggaccccattccccaggaatccaggttccacagtactctgacttggtctggctggtctcggctggcactttccctaggactgctaaaaccacggtgagggcggagagctgagggccgaagaaggcggggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281991 - DNA, 1635 bp, Homo sapiens
  misc_feature (149)..(149): n is a, c, g, or t
cagatggagcacagtgctgtgcaggatggagtccagacacccagcagtagcagaaatcgcctgtacgtgtttgggcccttcttcatctggcaaaccccgaaggaagggggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281992 - DNA, 1427 bp, Homo sapiens
accctgcagaagggcaggggtggcacctgggggctgcacgctgtcttccaggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281993 - DNA, 1814 bp, Homo sapiens
ccctgatgacctggccagcgctgtgtccggaagctgtgccttgggtggcggcttgggtgggaggccatgcggtcctgccctgatgcaggccccagcccccagccctcatcctcacatgcagatccctgggggaatgcaaggtgctgctcagtgatcccaggcttgcagggggtgcctgcaggaggccccacgtggacaggcagggccgcctctgcctatgagggcccaccatgccgcagcaccaggctggcacctgactcctggggctgaggctgccgagggggaggccagactgggaggggatggtgactcacaaggttaccatcagtgccttagaggaggggtagggtctgctgaccccaggcattcacagaggtgtcagtcccctctgcccagtgtgaatcctgaaaggcctgcacctgcccagactctgctttctgtccccttctgtcactgctgcctcctggggccactgtggtcccctggagtcactggctcctggggtcactgttgtccccgggtcaccactgtccctcggggtcaccgctctagccctgatgccacccggcccgccctttgtccttgcagccactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281994 - DNA, 2006 bp, Homo sapiens
  misc_feature (492)..(492): n is a, c, g, or t
cgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctactctgacagcctgctcggcccacagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281995 - DNA, 2334 bp, Homo sapiens
  misc_feature (492)..(492): n is a, c, g, or t
cgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaaaaaaaacaacaacaaccaaacaacaaaaaaaccacaaaacacacacaaaaccaaaaaatgcaaaacaccccccaccccacaccacatccacccacaacacaccacctcccctgccctaccccgcagcaccgccaaacagtcaccccccacccactcccttcatcattcctcctgccctcgcgccactcccctcacccccgccccgggcacccgcccgcgacgcgccgccacgggcccgccccgacccgcacgagcctcccgcccactcatcccgacccccgcgccccgcgctccgggcggcgcgccccccccgcgccggcccgcaccactcgtcgcccgggccgggcgcgcccacc

SEQ ID NO: 281996 - DNA, 1169 bp, Homo sapiens
  misc_feature (31)..(31): n is a, c, g, or t
  misc_feature (38)..(38): n is a, c, g, or t
cccaaagtgctgggattacaggagtgagccnctgtgcncggccgtctctctagttttactttgcaatgtcgttcatatccatcccctttctagtgccactgctgaagtcctaagtcactgcctcctaactggtcctcctaccctaactcctcccagacaggcttcctgccctaactcctctctgaccagtcctcctgccctgacttctccctgaccggtcctcctgccctaactcctccctgaccagtcctcctgccctaactcctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281997 - DNA, 1850 bp, Homo sapiens
  misc_feature (492)..(492): n is a, c, g, or t
cgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281998 - DNA, 1978 bp, Homo sapiens
  misc_feature (492)..(492): n is a, c, g, or t
cgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 281999 - DNA, 1191 bp, Homo sapiens
cagctgggccctgggaggcagggcctgggagatgcctgagaggggccgtggttggagggccaggctggctgcatgatggccctgggctggggtgtgactgcctgcagctactctgacagcctgctcggcccacagctcttcggggacgtctgctacaactgcagccatgtgattgaaggcgatggaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282000 - DNA, 2018 bp, Homo sapiens
  misc_feature (532)..(532): n is a, c, g, or t
ggccggacactcctggcggctgctcagtcttgcacgtggctgtgccaagcgggccaggcagctgctatttccctcagagaagttgctggcggcgctcagggaaggaagcacccgaggaggcggagcggcatctcagccacagagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282001 - DNA, 1682 bp, Homo sapiens
  misc_feature (196)..(196): n is a, c, g, or t
gtgacagggcagtctgctttcccataccctgggctgagcccctttgaagcccccagctgctcagtgaagttgcaggggtctggcctctcttctcctggaggtggccaggctgtgtgggagtgggggctctgcccctaatgcccccgcctcccgcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282002 - DNA, 2584 bp, Homo sapiens
  misc_feature (1038)..(1038): n is a, c, g, or t
atcggctctgccctggtctgggtgccccacggtgatgtttgtggcagagggtctcagagaagggagcaaagcagaatgtgggcctgtgtggctccggtcctcggtttcctaactgttggcagggatcctaaaggcgccaggtcctccctgtcctcctcagctgactctgccctcctcagtgtgtccacgggcacaggctttcctcctggcaggtggcagccggagacctcctgggtgtcctgccgccactgtggacctcacctcagtgctgtctggggccttcccagaccagtcccctcccagcgggacccaacccccgccagcctcagctttcaggagctgcccccgcggcgcgaacaatatcctttctatttggagttgactctgctgccctttggagatcccagcgcgtaacgtgagctcgcgaccagcgcgggggaggcgcccacacgcccgtcccgtcttggtgtctggccccaggcggccgcgcctcccctccgaggtggtcccatagcccctgcaccaggcggcccgcgcccgcgacctcaaggcggctgccccgcgccatggcggcccggctgggtgcgctggccgcgtcggggctgtaccggcggcgccagcaccggcagagcccgccgccagccacggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggaggtgagccaggctggtggacacgtggcctcaggttggggggtgccccagctcagggtcatgcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282003 - DNA, 1267 bp, Homo sapiens
cagctgggccctgggaggcagggcctgggagatgcctgagaggggccgtggttggagggccaggctggctgcatgatggccctgggctggggtgtgactgcctgcagctactctgacagcctgctcggcccacagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282004 - DNA, 1918 bp, Homo sapiens
  misc_feature (492)..(492): n is a, c, g, or t
cgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaanggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282005 - DNA, 1038 bp, Homo sapiens
cagctgggccctgggaggcagggcctgggagatgcctgagaggggccgtggttggagggccaggctggctgcatgatggccctgggctggggtgtgactgcctgcagctactctgacagcctgctcggcccacagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttacccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacacaa

SEQ ID NO: 282006 - DNA, 3546 bp, Homo sapiens
gccatggccgtccggcccggcctgtggccagcgctcctgggcatagtcctcgccgcttggctccgcggctcgggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactggcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagcttggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgccgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgctaa

SEQ ID NO: 282007 - DNA, 3889 bp, Homo sapiens
ccagctggtacggctcggatacgggatgtacagcaggcaggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgagggagatagagagggttggcggccaatgtagcccaacagaaccctgggcaccaacacctcccaggaccagagcctctcccggccccagcggaggtgccagaggcctccctgcccagcagcagggcccaccttgtcttgctgggagggtctgcaggagaaccgcagggtcctcttctgccccgagcatccgactccagcctcccatggccggaacatctgaacgttcattgatctcatcgatttctcaacccaaagccatcgagtgctttgaggtgaagaaaaaggctttccttacccacggcagataccacggcagtggcgccacgccgccaaagaccaaagaccccaaaccagaaacgttctgtggtcagacagggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactggcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagcttggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgccgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgctaa

SEQ ID NO: 282008 - DNA, 3574 bp, Homo sapiens
gccatggccgtccggcccggcctgtggccagcgctcctgggcatagtcctcgccgcttggctccgcggctcgggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactggcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagcttggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgccgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgctaaaaaaaaaaaaaaacgggcgccgctccga

SEQ ID NO: 282009 - DNA, 418 bp, Homo sapiens
gtcctgctcacccggccagtcatcctggctatggaccactgtggggagcccagccctgacagcttggagcctgcgcctcaaaaagcagtcgtgcgagggcagctgggaggtgagcagggaactgacccgggctccagaagggaacgtgggctaactgcacgctccacccggccttccaccgctgggtggtcctgagccgcacccccacccctccccagtctccggccacttcttgaagccacagctggccctagggctctgaggctgggccgaattgacccactgacccctgcccacaggatgtgctgcacctgggcgaggaggcgccctcccacctctactactgccagctggaggccagtgcctgctacgtcttcaccgagcagctgggccgctttgccctggtgggagaggccct

SEQ ID NO: 282010 - DNA, 306 bp, Homo sapiens
tgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggtaggaaggaccccagggggctctgagagctccacttccctcctggaggaggacgggacagccggacgttcctctcgtgcccctcggtgtcccgtgacagatcagcaaggaaagggggtggagttttggggagaacccagtcttggctggcaccga

SEQ ID NO: 282011 - DNA, 3681 bp, Homo sapiens
ccagctggtacggctcggatacgggatgtacagcaggcaggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtgaacggtgggtggtcgacgtggaccgagtggtccgtctgcagcgccagctgtgggcgcggctggcagaaacggagccggagctgcaccaacccggcgcctctcaacgggggcgctttctgtgaggggcagaatgtccagaaaacagcctgcgccaccctgtgcccagtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactggcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagcttggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgccgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgctaa

SEQ ID NO: 282012 - DNA, 2144 bp, Homo sapiens
gccatggccgtccggcccggcctgtggccagcgctcctgggcatagtcctcgccgcttggctccgcggctcgggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactggcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagcttggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccacagctctcccacctctgaggccgaggagttcgtctcccgcctctccacccagaactacttccgcc

SEQ ID NO: 282013 - DNA, 1205 bp, Homo sapiens
tgcgctgggactgatactgtggtcctggtcaccagagccaaaatagggggaaagctggcttggaaaaagcaggcaaccaagggtacacaccgttagccaatatttgcaaggctgttggcagattagatatatctgtactcaaacactgcaatctgatttctctgtcaaaagtacacttaacatttttgtcccattacttaaatctagtggattttctactcagcatcaggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282014 - DNA, 1119 bp, Homo sapiens
cctcccccaaacaggcatgtaatttatggatcttttacaaggtaataaaccacagtaattacctccctgcatcccaaactaagaggacaaattaagtcagaacttgaaaataatttaaaagagttttcccttgtttcaaataggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282015 - DNA, 1469 bp, Homo sapiens
tttgagggtgattaggcctgtttttattctgccacatttcagtaaggggaggatgtcactgtttcattagaagagctgtgctaaaaagatagacagtggagctcaggttgtttctgcacagaggtcctaactccaagagtggagcaagaagagattccaactgcactagaccctacttgcccttgagaagtccagagggactcccagcaggtctctggtgttttccagcctcagaggcctatcacctccctaagttgcaaagactatgaaaacctttttggtgggcagtggtgtgggagcagtgaattccagacatgctccatcgctcctaggctgtgctggatgtcgtgggcagtagcttggggaccaggagccaggccagaggaccctcttccagaaggcactcctttacctgagctggagctgctggttttctgctttgtgttttgtcgagactctttcatccaggggaagatttgtttggccactgtgggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282016 - DNA, 1034 bp, Homo sapiens
ccggagataagcgctagtgcggcgccgggctctgcctgggctagtggcaccgacttgggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282017 - DNA, 1236 bp, Homo sapiens
gggaaacggagtgcggggcggagaagagagaaaaggaaggaaggaaagggcaggaagaacctaaaaaaaaaaaaaaaaaaaagcaaccaaagaaaaaaggctgtgctggatgtcgtgggcagtagcttggggaccaggagccaggccagaggaccctcttccagaaggcactcctttacctgagctggagctgctggttttctgctttgtgttttgtcgagactctttcatccaggggaagatttgtttggccactgtgggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282018 - DNA, 1143 bp, Homo sapiens
caaaaatccgttcggcggcattttctcttcaaacccgcccggtcggatgtggcatttgaagaaagaaggcgtgggtcaataatcaacccgcactttctcctccaaactgctgacgcgactctcaccgccttctcagctaagccagctgccgggaaggccagctctccgaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282019 - DNA, 1720 bp, Homo sapiens
tgcgctgggactgatactgtggtcctggtcaccagagccaaaatagggggaaagctggcttggaaaaagcaggcaaccaagggtacacaccgttagccaatatttgcaaggctgttggcagattagatatatctgtactcaaacactgcaatctgatttctctgtcaaaagtacacttaacatttttgtcccattacttaaatctagtggattttctactcagcatcaggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaagcaaatggtcaccgagccggcagtcagctttctgggagtgggagatgatggggaaagaggaaagaatcgtccgctcgccggaccctggcttggagaagttctgcgctccgctgggactctgcgggccctttgcgtctacagacctatccctgccccgactaccccttcactcagacccagggaaggacacgtttctatgccttacagagacttgaagcctgaaagcctggccaagtttgggaagaagaggagccctctcagagctcaagagccttcctactctttggaacttttccacagtaggccaagcttgacaagagttcagctcaagttgaacatacatacacacactctcacacacaaattatgtgagccgtcagaatccaagtgaatccagctcaagctatctacaaggtttttacatgcaaggtcaagtatctcaatccagaggacttttgttttcttaatgaaaagcttagaaaacacatgaatcttagatttttaatgttttttaaatggagtttattcttagcacatggctttctatgtagccacatcacaatttgtacagttccacataagtctaaatgcactcccctctccccaaagaccgtgccccagaaggtgacaacagtatctctgtaacagtgtcttaaataaatgcaagtaagaaaaactaacatgtcacacctaccatcaaggtctacacatcttaagaattaaataatcttgtgaggtccacaa

SEQ ID NO: 282020 - DNA, 1194 bp, Homo sapiens
cctcccccaaacaggcatgtaatttatggatcttttacaaggtaataaaccacagtaattacctccctgcatcccaaactaagaggacaaattaagtcagaacttgaaaataatttaaaagagttttcccttgtttcaaataggaaaaggaaacgccaagacatagaaaaccacgcttttcccgtaggaagaaccgatgatgagccctgatgaaagaaggaagaagacccgctgtctgcgaaggcctaaaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaagcaaatggtcaccgagccggcagtcagctttctgggagtgggagatgatggggaaagaggaaagaatcgtccgctcgccggaccctggcttggagaagttctgcgctccgctgggactctgcgggccctttgcgtctacagacctatccctgccccgactaccccttcactcagacccagggaaggacacgtttctatgccttacagagacttgaagcctgaaagcctggccaagtttgggaagaagaggagccctctcagagctcaagagccttcctactctttggaacttttccacagtaggccaagcttgacaagagttcagctcaagttgaacatacatacacacactctcacacacaaattatgtgagccgtcagaatccaagtgaatccagctcaagctatctacaaggtttttacatgcaaggtcaagtatctcaatccagaggacttttgttttcttaatgaaaagcttagaaaacacatgaatcttagatttttaatgttttttaaatggagtttattcttagcacatggctttctatgtagccacatcacaatttgtacagttccacataagtctaaatgcactcccctctccccaaagaccgtgccccagaaggtgacaacagtatctctgtaacagtgtcttaaataaatgcaagtaagaaaaactaacatgtcacacctaccatcaaggtctacacatcttaagaattaaataatcttgtgaggtccacaa

SEQ ID NO: 282021 - DNA, 649 bp, Homo sapiens
tgcgctgggactgatactgtggtcctggtcaccagagccaaaatagggggaaagctggcttggaaaaagcaggcaaccaagggtacacaccgttagccaatatttgcaaggctgttggcagattagatatatctgtactcaaacactgcaatctgatttctctgtcaaaagtacacttaacatttttgtcccattacttaaatctagtggattttctactcagcatcaggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagccctgggggtgacgcgaacatcagggagtcaccagggcactcgtccgtgtggcgcactcattgctcgaaatgttccagtctacaaatggtccgaagatggtgatttatttttgtaaaataaatacatactccatctccacacccataaaaaatc

SEQ ID NO: 282022 - DNA, 1590 bp, Homo sapiens
tgcgctgggactgatactgtggtcctggtcaccagagccaaaatagggggaaagctggcttggaaaaagcaggcaaccaagggtacacaccgttagccaatatttgcaaggctgttggcagattagatatatctgtactcaaacactgcaatctgatttctctgtcaaaagtacacttaacatttttgtcccattacttaaatctagtggattttctactcagcatcaggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaagcaaatggtcaccgagccggcagtcagctttctgggagtgggagatgatggggaaagaggaaagaatcgtccgctcgccggaccctggcttggagaagttctgcgctccgctgggactctgcgggccctttgcgtctacagacctatccctgccccgactaccccttcactcagacccagccttccccagcgtgaatcagaacattaccaactgtctgcgcatccgtcccacttcatcaccaaagccaggatgtgaccgcagaaaacccaagcccgaactcacgtttccccggacgcggcgcgcatccctggactcgcagaaaccctgcggaaaaggccccaagatctggtgagggcctgccagctccgtcctccctgccgagggctctctcctgccttcctgaaggagttaaaagcctttggagataaatctgagggtgtgtgttttaaaaatcaaatgagcgagagtcccccagactgttctctatctgatgcatgtctctagagctgaacagtggaatggcagaatttcaaaacgcctgatggtggcatttgaaggcttccccaccacctacactagacacaagatttgagaggaacaacactttaccagc

SEQ ID NO: 282023 - DNA, 368 bp, Homo sapiens
acgcggcgcgcatccctggactcgcagaaaccctgcggaaaaggccccaagatctggtgagggcctgccagctccgtcctccctgccgagggctctctcctgccttcctgaaggagttaaaagcctttggagataaatctgagggtgtgtgttttaaaaatcaaatggtaagttggaatctcacttctgagagattcattcctagtgaggccctgacgactccgatccattcctgacgatctgcattaattatttaatgagtcacgtgacctcaaagattacaatttcaatatctcccttgcacaggcgctacacctttatcagctgcaaccagggtcctttttttggctctgccggcctccggggca

SEQ ID NO: 282024 - DNA, 2749 bp, Homo sapiens
caatccctccctccggcgggcgtcgctggcgggtggctaggcccaacggcaggaagccgacgctatcctccgttccgcggcgccgggtccgccttccgtctgttctagggcctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtga

SEQ ID NO: 282025 - DNA, 6043 bp, Homo sapiens
  misc_feature (3715)..(3715): n is a, c, g, or t
  misc_feature (3959)..(3959): n is a, c, g, or t
  misc_feature (4162)..(4162): n is a, c, g, or t
  misc_feature (4329)..(4329): n is a, c, g, or t
caatccctccctccggcgggcgtcgctggcgggtggctaggcccaacggcaggaagccgacgctatcctccgttccgcggcgccgggtccgccttccgtctgttctagggcctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaggaaaaaaagtttcatgatatctgttgttggcagtttttgtttatctctgacagtttttagttaaatgtttagatcctcagaactacattagtgcctactattaacttactctgtctcttgttaaaggctaaatctgcgcttctccctggtgccagcaggttcccctcacagtcaatgcagtggtatagcatatcctcacatttctagtgcccttgagactgtgctatggaaccaatcttgaacatacatgcattgacttgacaagttactgagtaagcagcatatcagcaggtgccactacagcctactctgccagacactgagcttggggccctagggaagatagagaattatacaaggcaaagtccttctctttagggctcttacaatctatcacttccaaaaagtaaatggtgactgataaaacaattggcagaacctgtttgattactgtgacagtcttaatgataccataaatcaatattagaaagctagttgacttaaagcctgaaataatgggagttttctcctccacttattagaataaggaccctcagtgactaattattgtgggtagggtcaagattaactagttttatacagagttctgctgtaaatagtcattttgcattgattagtgcagttctctgaatcataaagcaagttttacctctctgtacatgtttttgcagacatacttgaaaagctccttaaatctaggtgcttcaattcactttcttgagagnacaaatgaaaagctgtggagaaaatgtcctcattaaagtattaaagtgtgggcagaattacaattacaaagtgccagccaccgaataaagataaaagttcagttcttaaaatgagtttttatgagataacagtcagtgatcttggtgttaccgggattccacatggggcagtgggaaagagttcaggttttgaaggtaacctagtttagatttgaattccagctatgtgacattgggtaaattngtagtagtcctgagcctcagcgtcctcatctataaaatgactggcgaaaatacttcacaagctcattttgagcactttaggaagtaagtgaaagtacctaaaatagcaggcacccaattgatgattttatatcttccttctttgcttgcagtgatttcaggatgtcctcatatctatttataggtctaaaattatatcttaangtatgttgtagaataaattaaaaggataactaaatcaccatttagattaagcttgacttgcaaactaggaagaagcacctaggctttctttgaaaatatttttttggttcgttttggtaaagctctataaattggtatctattattttaccaatttttttttagtantaagtccatttagaactaaccatattatttatggaataattagcatgaggaaggtataattgcatttttttttttttgagacggagcttgcactgtagccccagctggactgcagtggcgtgatcttggctcactgcaacctccgcctcccaggttcaagcgattctcctgcctcagcctcccgagcagctgagactacaggcgcctgccaccacgcctggccaattttttgtatttttagtagagactgcgtttcaccatgttgggcaggctggtcttgaactcctgaccttgtgatccacctgcctcggcctctcagagagctgggattacaggtgtgagccgccgtgcccagccattgcatttttattcacatacacattgttaatgtggaacaatttaacactaatctcatcagagagcgagatgaatgtggcaattgctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacggtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggtgctttgtatattgtaaagtgctatataattataagatgttctaaattttcaaggatctaaaccagggattggcaaacgtttttccagggagtaaatattttacgctttgcatatataatttatggaggtgttgagaggatagattagacacttgaagtactcaggatagtgcctggcatgtaggaagcacctggaaaatattcgctgtgattaccatcagtccattttaccgaggaaggagccaaggtccaggcccactgaaggacttgcataacattacaatagcagtggcagaaccagccatgcttctgcaaatcacaacctctttgagcctctgtcacctgaactgcaaaatgagtgggttagacaaaatcatctgttgggacctcctagttccacgtgctatcattctactaactggcaccctaaggttgaaagtgcttatctgctttccaatgtggcttccttacagtctggaactgacaatatgcaggagcagtaaactggcagaaaaccaggaatcagagaaagaaaatataatttaactttaaagatgtaaattatatatatagtatattatatatatttttaaagctttatatgcctcaaatatcagggaaaggagccaagtccttggtatttagtttggtgaatacttgcattgaatacatgtcaagatgtcaagtcatttttgaatgtgtctcagggatttctatgctacacattcttttaacaaatcaagtatttatgtacacatgttcagattttttgacaaaatgattaaaataatgagatggaaaatga

SEQ ID NO: 282026 - DNA, 370 bp, Homo sapiens
aagaaattatttggtatacagtagtagacttgtatagaatttctaaacaatttaatgttaatagatttttggaaagactttaacggtgtattgaaaagttttatctacttcctgtgaacgtttgtctcaagttactgtgtaaattttgtgagcaggtgtagttaaaagaaaatcttgttaggcacctgcaattccgtgaaactgtacacaggagttggttacatagttttgtctaggttgtgcatgagcaaagaagcatgtgagccaaaaagtttaggaaacactgcatgtgtgtctttatcttactacattaatacacccaaacatgaagtatctgtttgctgagaaaatacttcaataaccacggtat

SEQ ID NO: 282027 - DNA, 242 bp, Homo sapiens
aagagtgaattttgtggcacatggattttttcctcagtaaagctgttatataaaaaaacatgagagagtaaattccttggcatattttgaatttttagttgatgattatgttgatagtaagcgtgtgcaacattcattgctgtgccatgtcttaagttattcaaaataatctgcagtcttaactttgttctcgtgaacttagcctctgtactgtgtgttctttagggacgattactttgcca

SEQ ID NO: 282028 - DNA, 1483 bp, Homo sapiens
gggaagcagaggagttgggagctggcggtcgttcccggggaagaactgctaaaacatgagaccaaggcacagaccttactgtatgagaagcaatgctcctcaaaccttctgcgtgctgacatagaccttcccagaagcaaaactgttggcggcgacctgagcgctggaagccgaaggggaagaggaaggagacgcgaagccagggcggccggcacaaaggcggcggactcgcggcggcagcgcctgcccggccgggagcacaacccacggccctactccagcgaagtcccgcaccggcttctaggaataaagtttacgttctcctgaggccgcaccccccacctcccacccaggacggcacatctccgtgtcctcctcccccaaactccactcgggaccccgagaaccaccccagccttccggccaccacaacaaagagccgcaccgaccggcgaggataaacagcggcggagggcgagagggcggcggggcgagcgcctccacgcagcaactccggagtcccccgcttgcccgagcgcagtttctccgctgctgtttccaccggctttgtaacactgggaatttacatcctcacccgcacccctcacgcccgaggattttaaactcacctttactctcgaactgagagttgcggtagatgggatttttgccttttccccagatggttgaaggttaagatttttggaaaccccaccacctccttatttctattattatttctgcaagaaaagtataaagagagttgtagtggaggtgagatttgtgatcgggaaagccttcgactccctccttctccgtcttccgcttctctctctctgattagttcctatccagcagcagattgaagcaggagatgattcttctcaaggtttgttcagcagcttcacttctaggcgaaggcttcatgaaccaagtgacgtcaaccaacaaggcttctctctctctcctctctctaacaatgaaagttgctgttaacaagggaaaaaaagagagagaattgtttataccatttcagttccaataataaatgacctatcagctcctaaaggagccaagggagggggttgcttcttctttccaagaatactgtagctttgagtttgcaccgttccttgtcccaggaaaaagttaagaaacttaaaatgttttgttttgcttttaaagaagacaggacagaaaacgggatttaaaacttagtttttaaaaaaacaaaagctacagagtagggagcataggtcaaccatctccacctaatttttttttgttcctaaactcagaattctacaacccaactaaattaatatgccaagattttgcggatgttaaaactcaaaaaaagcagtatgcaagacggtcccggggtaaaattctactgcctttccacggacaagttaaactggctgtaatgtttatgcactaagttaaaataaaatttaaataaaagacgttaaaatagtcgttt

SEQ ID NO: 282029 - DNA, 1095 bp, Homo sapiens
  misc_feature (1)..(1): n is a, c, g, or t
  misc_feature (4)..(4): n is a, c, g, or t
  misc_feature (13)..(13): n is a, c, g, or t
natntcggcacgngcggggaccttcatgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagcatctacagaaaatttcaataatgtacagtacactgagataaacagagaaagttggctccagctgccatctccatgtatgtatcatccacgctatcccctgctgcccggatgagactgaggagagaggatcagaagtcttgtgcaaccctggttggaatactctgcactgatattttttgaaaatcaactttattgaaatttagttttcagagagtaaacacacttattttaagtatgtgcttggatgcgttacattcatgaaccaccatggtaatcatgatatagaacatttctgtcgcccccagaatgcctttcatttccctttgcagcctgtctgtccccacaaccatggccccagacaatcactgatctgcttattgtcactatagattaatttttatctcttctagaatttcatgtaaatggactcttatgtagtcattttaatctggcttctcttgctcagcgtaacatatttgagattcacccatgttattgtgtatattagtaatttccttattactgctgaatagtatttcatttttatacattcacttcttgatggacatttgggtaatttttactttttggctattgtgaatgatgctgctgagaacattcatgtacaagattctgtatacacatatattttcatgtttcttgggtagctacctgagagaggagttgctgcctaagagtagtaaggaaagtatatgcttaacttcctaagaaactgcccagctgttttttgaagtgactgtaccatcgacattcacacagcaatatgaaaattcagtttctccacatctgtgccaacacttggtattggaggtcttttgaataatagcctcttgtgggtgtcccatgtggcattaaattgtatttcccta

SEQ ID NO: 282030 - DNA, 1905 bp, Homo sapiens
  misc_feature (7)..(7): n is a, c, g, or t
gccaacnatacgcctgctgccgcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccagggtttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgtagtgctgtgaaatgtatttatattcta

SEQ ID NO: 282031 - DNA, 1923 bp, Homo sapiens
  misc_feature (7)..(7): n is a, c, g, or t
gccaacnatacgcctgctgccgcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagtaatttctgctttgacagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccagggtttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgtagtgctgtgaaatgtatttatattcta

SEQ ID NO: 282032 - DNA, 1776 bp, Homo sapiens
  misc_feature (7)..(7): n is a, c, g, or t
gccaacnatacgcctgctgccgcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccagggtttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtataccaccatgaagaaatatattggtgatgagttctattgaggaattttgaaaagagagaaggatttagaaaaaagactctttctcggccgggcgcagtggctcacacttctaatcccagcacttgggaggccgaggtgggtggatcatgaggtcaggagttcaagaccagcctggccaacacagtgaaaccctgtctctactaaaaatacaaaaagtagctgggcgcagtggcgggcatttgtaatcccagatactcgggaggctgaagcaggagaattgcttgaacccgggaggtggaggttgcagtgagccgagattgcaccaccgtactcctgcctgggcgacagaactagactctgtctc

SEQ ID NO: 282033 - DNA, 2059 bp, Homo sapiens
  misc_feature (7)..(7): n is a, c, g, or t
gccaacnatacgcctgctgccgcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaaggtatagaatttttatctcgatgtttgaccagggttgggaatctacattaaaacattcttaggccattgctttctaacttttatagcatctacagaaaatttcaataatgtacagtacactgagataaacagagaaagttggctccagctgccatctccatgtatgtatcatccacgctatcccctgctgcccggatgagactgaggagagaggatcagaagtcttgtgcaaccctggttggaatactctgcactgatattttttgaaaatcaactttattgaaatttagttttcagagagtaaacacacttattttaagtatgtgcttggatgcgttacattcatgaaccaccatggtaatcatgatatagaacatttctgtcgcccccagaatgcctttcatttccctttgcagcctgtctgtccccacaaccatggccccagacaatcactgatctgcttattgtcactatagattaatttttatctcttctagaatttcatgtaaatggactcttatgtagtcattttaatctggcttctcttgctcagcgtaacatatttgagattcacccatgttattgtgtatattagtaatttccttattactgctgaatagtatttcatttttatacattcacttcttgatggacatttgggtaatttttactttttggctattgtgaatgatgctgctgagaacattcatgtacaagattctgtatacacatatattttcatgtttcttgggtagctacctgagagaggagttgctgcctaagagtagtaaggaaagtatatgcttaacttcctaagaaactgcccagctgttttttgaagtgactgtaccatcgacattcacacagcaatatgaaaattcagtttctccacatctgtgccaacacttggtattggaggtcttttgaataatagcctcttgtgggtgtcccatgtggcattaaattgtatttcccta

SEQ ID NO: 282034 - DNA, 956 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatc

SEQ ID NO: 282035 - DNA, 414 bp, Homo sapiens
accagtcaccttctccctcagtaagcctccctctattccccaggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282036 - DNA, 1248 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282037 - DNA, 1447 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatc

SEQ ID NO: 282038 - DNA, 1908 bp, Homo sapiens
  misc_feature (374)..(374): n is a, c, g, or t
  misc_feature (1188)..(1188): n is a, c, g, or t
  misc_feature (1191)..(1191): n is a, c, g, or t
cgtgcgcgaacgtgggcacagatctggtgtctcttgtctcttcttgcatcgagacgttcgccgtagcaccgttccctcgctgttctttacattctttttctctgtgttgactctatccttcgtgttatgtgctagttgtgctggcctcgatcggtcgttcctccactgctgtggtctgcgttactgtggttcaagagcccatcagctggtgccctcgacactgcgggtccgtctctcgttttgatcgttcagtagggtttctccatcccgggggagtgtaccatttcaccattgttctaaactttacatgaccagtggttacgccagggagaaatagtgatcacggcatgttcagcatggacgacttggtcctntggtcggtagaaagatggattgttgacagaagagcattggcagcccctgtcaggatctccttctgtacagctggtacttctcagaggctaagatcatttggacagcatggggtccaccggcagctctgccatctttcgaccagacgtggtgagctccccaaggtggttgagggctcccagagcatacagctgctccgaaagccagcagcagtgtctcatactggtggagggctcctaggaaagtcaagagtgcattaggtcatggtatcccgtaagcttcttgagctagcaactacgacgattgccctaagcgtggtccgcgtggatctgcaggcactggtggttgtccgtcatgcatcgtgcatgtataggctccaggcgtgtatatctaggctggatagctacttcgcctgctagcctacccgtaccgtgccctgctctagcttcgctggtattgcgctggaggccttttgctgtctagggtgctgtactagtggtagcgtatttcctatgctctgtcgactgggggtcgtgtgagcttctgtcgtgctgtagcgagagagccctcggagtcgcagtcatcactatcagtgagtgcccctcagactggatgacgtgactgcgcgtcgagtcaactgtttccgttgtcgcatcaacgcacacgttgtcgttggccccagggaggatgatggcgaatggaagataacgggaacagacaatgatacagagggcagaaaggcaaaaaagagacaagcaacacaagagaaaaaccaggaaaaatggaaaacagacaaagacaagaaaaagggcggcngcncgcgatctagaactagggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282039 - DNA, 1531 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatc

SEQ ID NO: 282040 - DNA, 1178 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccgctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282041 - DNA, 2010 bp, Homo sapiens
  misc_feature (374)..(374): n is a, c, g, or t
  misc_feature (1188)..(1188): n is a, c, g, or t
  misc_feature (1191)..(1191): n is a, c, g, or t
cgtgcgcgaacgtgggcacagatctggtgtctcttgtctcttcttgcatcgagacgttcgccgtagcaccgttccctcgctgttctttacattctttttctctgtgttgactctatccttcgtgttatgtgctagttgtgctggcctcgatcggtcgttcctccactgctgtggtctgcgttactgtggttcaagagcccatcagctggtgccctcgacactgcgggtccgtctctcgttttgatcgttcagtagggtttctccatcccgggggagtgtaccatttcaccattgttctaaactttacatgaccagtggttacgccagggagaaatagtgatcacggcatgttcagcatggacgacttggtcctntggtcggtagaaagatggattgttgacagaagagcattggcagcccctgtcaggatctccttctgtacagctggtacttctcagaggctaagatcatttggacagcatggggtccaccggcagctctgccatctttcgaccagacgtggtgagctccccaaggtggttgagggctcccagagcatacagctgctccgaaagccagcagcagtgtctcatactggtggagggctcctaggaaagtcaagagtgcattaggtcatggtatcccgtaagcttcttgagctagcaactacgacgattgccctaagcgtggtccgcgtggatctgcaggcactggtggttgtccgtcatgcatcgtgcatgtataggctccaggcgtgtatatctaggctggatagctacttcgcctgctagcctacccgtaccgtgccctgctctagcttcgctggtattgcgctggaggccttttgctgtctagggtgctgtactagtggtagcgtatttcctatgctctgtcgactgggggtcgtgtgagcttctgtcgtgctgtagcgagagagccctcggagtcgcagtcatcactatcagtgagtgcccctcagactggatgacgtgactgcgcgtcgagtcaactgtttccgttgtcgcatcaacgcacacgttgtcgttggccccagggaggatgatggcgaatggaagataacgggaacagacaatgatacagagggcagaaaggcaaaaaagagacaagcaacacaagagaaaaaccaggaaaaatggaaaacagacaaagacaagaaaaagggcggcngcncgcgatctagaactagggaacatctgtctgtcatgtatgagagactgagacaagagcttcccaagctcttccttcagtcccacgactacagtctgtattccttggatgtggaattcatcaatgagatcctcaacatacgtaccaagtgagaattggggcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282042 - DNA, 697 bp, Homo sapiens
accagtcaccttctccctcagtaagcctccctctattccccaggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatc

SEQ ID NO: 282043 - DNA, 467 bp, Homo sapiens
gaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggaggtatctccattgtactccagcctaggcaacagagcgagactccgtctca

SEQ ID NO: 282044 - DNA, 636 bp, Homo sapiens
ggctggtacgcccccggagtaaacgggatgaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282045 - DNA, 1479 bp, Homo sapiens
gtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282046 - DNA, 1489 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282047 - DNA, 1332 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282048 - DNA, 757 bp, Homo sapiens
cccctcgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 282049 - DNA, 3357 bp, Homo sapiens
  misc_feature (2)..(3): n is a, c, g, or t
gnngagggcggggccggaggtttcgattagttgtctctgccgctggggaaggtaaagcggcgacggcgtcctcaggagctgtggggtcccctgctagaagtgggggactcggcgggggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaacgc

SEQ ID NO: 282050 - DNA, 3334 bp, Homo sapiens
tggggtgggggagttggaggaggaagaccctacaggaagttgagctgtactctccaacaggcgagcacatggtcgtctcctctctcccttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaacgc

SEQ ID NO: 282051 - DNA, 3459 bp, Homo sapiens
  misc_feature (2)..(3): n is a, c, g, or t
gnngagggcggggccggaggtttcgattagttgtctctgccgctggggaaggtaaagcggcgacggcgtcctcaggagctgtggggtcccctgctagaagtgggggactcggcgggggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaacgc

SEQ ID NO: 282052 - DNA, 959 bp, Homo sapiens
ctgcgacttgggggtgtccgagagcggcctcttcggcgtcgagaggaggtccgggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaacgc

SEQ ID NO: 282053 - DNA, 784 bp, Homo sapiens
ctgctgcacacacagcctcacacaaccacacactcacagccacaaacccccagagtcatgcacatgccgacgcaccttgtggcacatgcacacacaaccacacttgtgtgcaaagtggcagacacaaccacacatgcatagaagcaagtctctggaccccttctgcatcccacagagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgcttacctgctttcgtggaccccgggactccggccggctggccatcccatcccttgagaaacagggaacctaatcggaaactgggtgggaggacagtgacctgacgagaaccat

SEQ ID NO: 282054 - DNA, 2509 bp, Homo sapiens
taaaccattaacaactcttcccccttttattttttatttattatactcattttttgttggaatcctacccgcccccctccgccccgcccacggcccctttaaaattgacagccaagatttgctggcaaacattctttttgtccttggatgctacaattccaggttctgccttttatctcccaagctcagaagtttcctggggccaatttttgcagctcaaaattgtccgtgcgattttgttcttcaccgctttgaaacaggaacaccttgccctgttgctttgccactccccattttctttggggatgactgcctccaggaatactcattttatattagtcaaaggggtgaaagtttgcattgacttcttaggtggtgtatggggggtggtgaacgtatttgagacatgcagatggcaaaaaaaaaagctatcttaggggacagaaggctgagctctcaaatgcccaggatcccaccacccttgggtaattctctgtccactcctttataggccaagagtggcttgaagggggtgcagagccttctaatgtataaggtaagatcaactggccgggtgcagtggctcacccctgtaatcccagcactttgggaggccgaggcaggaggattgcttgagcccaggagtttgagaccagcttgggcaatatagtggggccttgtctctacaaaaaaatagttaaaaattatctgaatatggattgcttgagtctagaaggcggaggttgcagtaagctgagatagcgccactgtacaccagcctgggtgacagagagaccctgtctcaaaaaaaagaagactgtggctgggcacggtggctcacgcctgtaaccccagcactttgggaggccgaggagggtggatcacttgaggtcaggagttctagaccagcccgaccaacatggtgaaaccccatctctactaaaaatacagaattagctgggtatggtggcgcacgcctgtaatcccagctacttgggaagctgaggcatgagaatcgcttgaacctgggagtcagaggttgcagtgagccgagatggcaccactgcactccagcctgggcaacatgagtgaagcttcatttcaaacaacaaaaaaaaagactaactaaagaccaatggtagggggtggtggggagactctgtggcagaggttcccagttcactcttctcttcctaggatggggactctgtcctgcagagggggggctctctgagggccccagccctccccagccgctcagaccgcctgcagcaacgcctcccaatcactcagcactttggaaagctttgagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282055 - DNA, 2746 bp, Homo sapiens
acacaggaagctgagccggcttggggcccagcatacacaggcccccaggacccctggggagagggccccgctgggctggccctgcagggaccatggaatccagagctgaatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctccccaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagctttgagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282056 - DNA, 1238 bp, Homo sapiens
gaatcttctccgcctaggcacaggaaaagtttggaaaggacaagtccatcggctcatcccacaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282057 - DNA, 1161 bp, Homo sapiens
ctagaggatctacagaggcacaaggaggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282058 - DNA, 569 bp, Homo sapiens
cgactgctgcgttggacttttgacagttgctgtttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282059 - DNA, 2403 bp, Homo sapiens
acacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctccccaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggtaagatcaactggccgggtgcagtggctcacccctgtaatcccagcactttgggaggccgaggcaggaggattgcttgagcccaggagtttgagaccagcttgggcaatatagtggggccttgtctctacaaaaaaatagttaaaaattatctgaatatggattgcttgagtctagaaggcggaggttgcagtaagctgagatagcgccactgtacaccagcctgggtgacagagagaccctgtctcaaaaaaaagaagactgtggctgggcacggtggctcacgcctgtaaccccagcactttgggaggccgaggagggtggatcacttgaggtcaggagttctagaccagcccgaccaacatggtgaaaccccatctctactaaaaatacagaattagctgggtatggtggcgcacgcctgtaatcccagctacttgggaagctgaggcatgagaatcgcttgaacctgggagtcagaggttgcagtgagccgagatggcaccactgcactccagcctgggcaacatgagtgaagcttcatttcaaacaacaaaaaaaaagactaactaaagaccaatggtagggggtggtggggagactctgtggcagaggttcccagttcactcttctcttcctaggatggggactctgtcctgcagagggggggctctctgagggccccagccctccccagccgctcagaccgcctgcagcaacgcctcccaatcactcagcactttggaaaggtgagagcgcccctccccccatgcacacacctggaattatcactgaatcctctacccatcccagtccccatccagacatctcacctccttcttcaactccccaaatatgtggcacccacttcacactcacccttctccagcaagcctcagccccc

SEQ ID NO: 282060 - DNA, 602 bp, Homo sapiens
cccctccccccatgcacacacctggaattatcactgaatcctctacccatcccagtccccatccagacatctcacctccttcttcaactccccaaatatgtggcacccacttcacactcacccttctccagcaagcctcagccccccgattctgcagtctcctgaggtcctatcgcccccaccctttgagaaccggccccttcgccccagcaggagacgccagctggaagagggaacttccgagcccccaggggcggggtaaggcaaaaagggaacagcagtgttgaaagtgggaggccaggactgatggggaggagggttcccaaactccagagcagcctgaccagggctgggggtcttgggcaaatatctgaggctgcccatcctcacccaggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctg

SEQ ID NO: 282061 - DNA, 2811 bp, Homo sapiens
acacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctccccaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagctttgagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282062 - DNA, 325 bp, Homo sapiens
actcagggtcctaggagctttgttggggagcggggacatcctcagacagctgggatgtccaggtctctctaacagcccttcccactccagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtgagaccagcccctctctcactcctgtgggagtcccagccccca

SEQ ID NO: 282063 - DNA, 2509 bp, Homo sapiens
acaaggcgcgttctgcgtcatagctccacctctttcggggtggagtcagtggaggctcagtccttgctctacctgcatggggaagactcaggggtgttgcctattaactgcgccccttacagagagggatcaggacggtatgagtcctggcttcacccgcttaaagcactgtaagtggccaaattcctggtctccacatgatttctaaaggggttcgagttgtcactcattatccagcagtggatggggagggggaacaggagactggggacgtgggaaatgcagctggaagagacctcgcgctagagggtccaggccctgactccacgccccgccatcgctccccagctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgaggtgagcgtggatctacccagacgacggggacgtgagggttcccccttcctctacatccccagatgccctcctctgccaaggactcccgggctctgagcggccgaccccgcttttccgcagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctccccaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagctttgagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282064 - DNA, 1375 bp, Homo sapiens
tagctgggatcacaggcgcacaccaccacccccggctaatttttgtatttttagtagagacagggtttcaccatgttggccaggctggtctcgaactcctgacctcaggtgatccactcaccttggcctcccaaagtgctgggattacagtcgtgagccaccacgcccgacctttgagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcaaaaaaaaat

SEQ ID NO: 282065 - DNA, 2558 bp, Homo sapiens
acacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctccccaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagctttgagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagccca

SEQ ID NO: 282066 - DNA, 1482 bp, Homo sapiens
acacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctcaaaggtggtggcgccctcctgcactcagtcaaggccaagacccaaccagccgtcaagaacatgtaccgctcggcaagagtggttgaagggggtgcagagcttctaatgttacggggggggaccgctggaaagggggggcctaggcc

SEQ ID NO: 282067 - DNA, 470 bp, Homo sapiens
aggccagagatggcttctacatcttgacagcaggcaggcttcgaagtgctggcattcagatgtgtctcctgctgtttctgatttactgtcccccaccccagttcatcgaagcccggctggagaagctcaacaagggggagggcttctcagatcaattcgagcaggagatcactggctgcggggcctccaggtgagccctgagtccagcccctgggtcccccactacccgccaccagcacccccagcctcagccagccttcggtgaccaccacactctctccttaccccaggggcccttcgatcctatcagctctgggccgacaatctaaaggtaagaccaccagaacaataggccgtgggcgttggcttaggcctgtaatcccaacacattaggaggtggagatagaaggattgctgcgaccagaagtttgagaccggttagggcaacgtgacgaaaccccatctctact

SEQ ID NO: 282068 - DNA, 473 bp, Homo sapiens
aatcccagagctcttgtgaagttactttcatctatggatggttattaaattggtgttttcagcttacagtgaaagatcttcagaacaccaattcagttgccttcagggttaaaccataatatcaacacaaaatggatcaagagccagtcatcctaaaaagaccacatgcatggcccctgatctagcaaaagtagtcacaaatgcagctgaatgtgtggaaacctctaagagaaaatgtgtgaatcacagaaagagtggctccagtcatggaacgtggagaaagctgccacagaagcaaaggctgcctatgctcatgccagcactgacagggagaactctccgccctctaccttgggtattctggctccaatgacagggctgtctctggaatgaagttctggatcatagtcctgagagaaattccaagactcatcttttttcatccagatttctacactccagaagggtaaaga

SEQ ID NO: 282069 - DNA, 163 bp, Homo sapiens
atggattaaagtgctgccctcccccacccccagcagctggtgacagtgacgataatcaccaaaacagctgctaagatcggtgtctgtcacaccaacagggatacatacaggacttcctctgacaacctccacagtcaagcatccaccaggaaacttagtgaat

SEQ ID NO: 282070 - DNA, 470 bp, Homo sapiens
gtggcttgggtcaatagtcccagcagagctgagccttcaagtcttcctagcccaggcaccagagatgggagagaggaactctccagggagaaaaagtaaacatagacaggtcgtcagccagggttcatcgggaggctgcggttttcccagctgtggagtggccacctcctcccagcctccctgagtcagccatggactccagcggggacacactgtgggaaacgtcgtgggaaaacagcaaacccagggagcgaaagaaaataaagaccagcagtgacccctccactcagagagacctgtggacaccatttgcggcgtttatccagcagttttttctttctaccggtgtgtgcatgtatgcatgcctttgtgtacatagacttgtgtattacagcgttgtgcaacatggatattcatttgacgatactgtgaatgtttttccatatcattaaatgttcttacatcacata

SEQ ID NO: 282071 - DNA, 2156 bp, Homo sapiens
atgatataaattatgcatagattccctggaaagccctcaaaagtctgctaaattcctgttgccaccaaatattgtttctttggggaaatatattctgattcctaacaaccaacaataatcataagttttaaatctctcctctctcctctcatgcagtttatgaaacgggctgcttttctgtttgtagctgaggccacaggagctggagggattgcaaagacctttattagagcatccatctggtgaccctggcagggaaacttaggatctaaccctaggatctggctagggctctgtaactgactgttagccagccctgcctctccaggataattatatttatagtggctttgcctcaggaggtttctggaggttgatgaccatgccaattattaactccttagcttcctaatgtagaacatttaggagtgacaggagttgttttctttgcttctcaacaggtgcctacctattgggccgcctttgtaccttgagttttcagttagcaaaatgtgaattgtatgaactaattcttccttgacctcacaggtggtggtaaggattcttgaaaagtgggtaagatccttagaaaaaagatgttcataaagtgtgactcctaggacaggatacaagataaattctgtcccacaaagcacctcatattttgtataattaactatcttcatggcatttgcattttctacagttcactgattttacctcttcagctttatttactatgctgcttttttgtgttaaagtgaattagtgtgtcagcttaaaacacttgtggtgaataattcatatcattcaataagcattaactcttaaatgtgaagtcttatcagccagggctgtgaaatataattgtcaatggtgataaacaattatgctttggtttttagtgaatgaaaaaattaagaatgagggaaccttaacatttttaacctaaaagattgtattttgccaactttccttgggcaatttgtgaatactgcaaatctcaggcatatgtcatcagtgattctaaagggattgtatttgttcctgcatttgttcttgagggtaaaatagcttttcatttgaatgatgcttttgagttggcagcaggacagggatcagataatttgttgttgtttacagattatgttttactttattgtgatgtaattatagatcataattctcatgtttgtccttctcttttttcccttcctttttctagtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccaggtaggttggaatgttcagtgatgttctgtagtcatatcagacagtgttatcacagtgtcacggaaaagctgggtcaacctgcagtggagggaggttttcagccctggtatatgacatagtgctctcgcacttttaggatacaacttttggtgaaaggagacctcatagtcaagtaagcaaatgtcttattttatttgtcaggcacagatgcttgaataagctatattttccccttgtttttaaaaggttttgaaacagctgcatccttctgggagtggcataattgttacagtctttactcttgataaaaagaaaaataccgtgttacacacatttgctcttatgagaacacaacctcaatcagcatcgttttcatacatggaaaaaactcctgttgcaagtgcaacctcagaaaaaatatttcctgagggatcccaccccctacttaattaaattcattcaaatgatgatgtaatcccaagaaacgtatactttaacaacaaaggaattacaacagaagtactggaaaccatctgcttgttcaacttagcaaagacaaaaaacaattatcctctttttctagacataactgttggtgtaatggttatcaaaataaatgattaataaggacattatatatttttaagttacaggttaatgagcaagcatctcc

SEQ ID NO: 282072 - DNA, 3102 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282073 - DNA, 3195 bp, Homo sapiens
cccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtttggcggcggcgcgtaattttttccccctcttccgcctacacccgctgcgtctcctggtgtctcgttcctttccctttaccggagtcgattgcctcactgcatgtgtattcgtgagttcgcggttgaacaactgttcctttactctgctccctgtctttgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282074 - DNA, 3334 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaagactgggagatcaaaattatcatcaccaatgagagacagatgggtatcatatacctccagatgtcataccctgagaaggccataacatcacctacgcaggattccagctgagaatgcaaatccgaatctaatcctgaggaaatatcagacagactcaaagcaagaaacattctattaaaaagggtgaagaagggggagtaattctttcaaaatatcaatgtgaaaagacaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282075 - DNA, 3205 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccgcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282076 - DNA, 2902 bp, Homo sapiens
accgagtaactgtgtcaccattccccgctctctggatggcaggctgcaagtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282077 - DNA, 3084 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaatgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282078 - DNA, 2841 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatggcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282079 - DNA, 2339 bp, Homo sapiens
cattgccctcagtcctcaacaggatttctctagcactgaagcctgaccataatactcaattgcaggtctgctccacataaaactatgtaactagagtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282080 - DNA, 2110 bp, Homo sapiens
aaggattaatcagaacttcacattcattgtccaccctcaccaatgagtttttgatctttgcagtagcagttacttttctctttttcatagtgactttattctatggaactgtattgtcttaatgcactaattctgccaagctaccttcttgtacaaatgaatgatagaatgtattgattcatggcaatggctaggtgtcaataatagctttttggatacttgaatgtactcctgcccgttttgctcagagattgaaagatcaagagctgtgtgttgatagggggaccttcagtggctgaatagggaagaaattgaatgtcattctgtctagcatagcttttttgttttattttcttgatgataaaatgagaatttaataatagctattacattactatcagtaatgggcaattaaaagttttaaagtgtctttattaagataactttataatgtattttaaaaccttcattcctcaagaccagcaattcttattggaatccatggatggaccctggggagctaacatccatcccttgaaattgcctgcgaaattatgtgtgcgtttgtgcatgtgtgtttttttctccccaggggcgggggggtcagggaggaaagatgcatagctttaatcagagtctttggttatgtgaactcttcttacttaataagtttaaccactgagttaaacaagttaaatgacctccagtatgtttttcctagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282081 - DNA, 3048 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatcttttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282082 - DNA, 3147 bp, Homo sapiens
cccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtttggcggcggcgcgtaattttttccccctcttccgcctacacccgctgcgtctcctggtgtctcgttcctttccctttaccggagtcgattgcctcactgcatgtgtattcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282083 - DNA, 3005 bp, Homo sapiens
gatgtgctttaggaggggaggaggaacaaatgcctgccagatctcacagctacagtagctgagcttttgtttattttgaagagcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282084 - DNA, 2908 bp, Homo sapiens
ccggccgcgctgcgctcacgccggccgggccgggaatttggagaggatccctggtcgcgcggcagcggcggcggcgcgcgggtgagcgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282085 - DNA, 3187 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccgcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaatgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaattt

SEQ ID NO: 282086 - DNA, 1167 bp, Homo sapiens
agcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctggaaagggcttcctgggtctgagttggcggccg

SEQ ID NO: 282087 - DNA, 2943 bp, Homo sapiens
gggggctgctgggaaggccggcgggatggaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282088 - DNA, 2906 bp, Homo sapiens
gggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282089 - DNA, 2914 bp, Homo sapiens
gggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataagcgtttctggtgtgtgttttttgtcgtattgtga

SEQ ID NO: 282090 - DNA, 2887 bp, Homo sapiens
caggcgtccggggaccgcctgtttacctaatccggggcggacggcggtgtggccccaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282091 - DNA, 2692 bp, Homo sapiens
ctggtacccgtcgggtattccgggatatagtcagaaccacgctgttaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282092 - DNA, 2472 bp, Homo sapiens
gggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282093 - DNA, 2553 bp, Homo sapiens
gggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggccttccagaccagagcagaactaagcctcgcggcttggggacctgggctcctccggttaaccggcggggtctggtttgagaaaaagtttgggcggggcgccttaggcacggagaaaccgggccccacggcctttaaggacgccagggtatacccaacgggggttcaccggaactcgggggcccggggtgggacggcctgcataaaggacccgccccggcgaaggcattcccgagcacaatgaagagaagagggagaccacagacggggcaa

SEQ ID NO: 282094 - DNA, 1878 bp, Homo sapiens
gctcggtaccatctctccactctggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282095 - DNA, 1551 bp, Homo sapiens
tagcggatgctatgcttgggggcgaaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282096 - DNA, 825 bp, Homo sapiens
aagcgtatacggtagtacaggctgggtgggaatcggccgagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282097 - DNA, 748 bp, Homo sapiens
gggggctgctgggaaggccggcgggatggaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccctgttgcgggtgaggcggctgctctctattttcagatgttgctgtagaaataaagacggtttaaatctgaaaaaaaaaa

SEQ ID NO: 282098 - DNA, 643 bp, Homo sapiens
ggggtggacgtgtaaacggccagtgctaacaccgtcactgtggagatggacgggagtgtcagggcaccagggtgtggccttgggtcagaactgccattgcctctgcccagctcagggattccggctgcctctgccaggtcagaccccttcaggccagggaggcacagactggcagcagcacagggctgagccacctgccccctctgcccacagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcg

SEQ ID NO: 282099 - DNA, 639 bp, Homo sapiens
ctggtacccgtcgggtattccgggatatagtcagaaccacgctgttaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacg

SEQ ID NO: 282100 - DNA, 2610 bp, Homo sapiens
ggctagtagaggccgggtttaaatcggacgaggattgagcttgggctgggggaggccgtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282101 - DNA, 2899 bp, Homo sapiens
cggcccgcgctcctttaaggcagcgaacgggccaagagaagcgtgtttcgccccctccgacgccaccgaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282102 - DNA, 2479 bp, Homo sapiens
ctggtacccgtcgggtattccgggatatagtcagaaccacgctgttaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282103 - DNA, 2574 bp, Homo sapiens
gggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggccttaagttcagagccaggcctggctctgaacttaggcctggctctgaacttaggcctcctcttcggcctcctcaccgaaatcctcctcctattctgcggtggcatcctggtactgctgatactcagagacgaggtcgttcatgttgctctcagcctcggtgaactccatctcgtccatgccctcgcctgtgtaccagtggaggaaggccttccggcggaacatggcagtgaactgctccgagatgcgcttgaagagctcctggatggctgtgctattgcaatgaaggcgat

SEQ ID NO: 282104 - DNA, 2050 bp, Homo sapiens
gggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgccgtcgcacgcacggggatccttagat

SEQ ID NO: 282105 - DNA, 1092 bp, Homo sapiens
aggtgactctccaggatcttacgggagccttaccctaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaa

SEQ ID NO: 282106 - DNA, 471 bp, Homo sapiens
cagcgcagtgagcaggccgtggcccagctcgaggaggagaagcagcacttgctgttcatgagccagatccgcaagttggatgaagacgcctcccctaacgtgagctcctaccatggtcactgttgcccagcaaggaggcctgggagcagggaggggcagcatggagcagattcggctccaccccagcccatggacaccccggctgccctgtgcctccttccctgatgctcatcctgtcttccttcccaggaggagaagggggacgtccccaaagacacactggatgacctgttccccaatgaggatgagcagagcccaggtgcggatgggcagttctggagtgggggaaggaaaggttgtgtgaactcttggtccttgggaccgagtggctgccatgttccttcctgcctcacttctgatcatgacatcctagtgtgttagagcttcaagaacagttgtacgtgctgctgc

SEQ ID NO: 282107 - DNA, 7023 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaagggcttatctctgcccccattgatttttaacctcaaaatggtgtgagatttactgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctaggagggcaggttaggagacagttatgtatggcctttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctacaaaaaaa

SEQ ID NO: 282108 - DNA, 6717 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaagggcttatctctgcccccattgatttttaacctcaaaatggtgtgagatttactgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctaggagggcaggttaggagacagttatgtatggcctttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctacaaaaaaa

SEQ ID NO: 282109 - DNA, 7131 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaagggcttatctctgcccccattgatttttaacctcaaaatggtgtgagatttactgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctaggagggcaggttaggagacagttatgtatggcctttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctacaaaaaaa

SEQ ID NO: 282110 - DNA, 7265 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatgactgacagtgttgtacttactctaaatttcccaaggcaaattagtctgtgttttggaaagaattctgcagctgaactatacattgtttctaagaaggagaaggtgccttaactttccaagaaaatttactgcaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaagggcttatctctgcccccattgatttttaacctcaaaatggtgtgagatttactgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctaggagggcaggttaggagacagttatgtatggcctttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctacaaaaaaa

SEQ ID NO: 282111 - DNA, 6858 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaagggcttatctctgcccccattgatttttaacctcaaaatggtgtgagatttactgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctaggagggcaggttaggagacagttatgtatggcctttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctcctggcaaagagccaccctaggagccacccgaagagccacgcaaagcgcaccccacgcagcgacacaac

SEQ ID NO: 282112 - DNA, 6896 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaagggcttatctctgcccccattgatttttaacctcaaaatggtgtgagatttactgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctaggagggcaggttaggagacagttatgtatggcctttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctacaaaaaaa

SEQ ID NO: 282113 - DNA, 1880 bp, Homo sapiens
gaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatgactgacagtgttgtacttactctaaatttcccaaggcaaattagtctgtgttttggaaagaattctgcagctgaactatacattgtttctaagaaggagaaggtgccttaactttccaagaaaatttactgcagggaataagagagtcccctgtgactaaagcaacagattagattattcagttgaataatcagacataatgaaaggatcaacaggtctgctcggatgaatcagggggttagaggcgcatttgtcaaggccacataattgttcatgggtttcaaaaatgattccaaaatgcagatgaatgtttttacctatcaagaacctacaagtgtacaggttgcttacttaacaggaagtccctacaacggactaatctgaatgcatttaggtcttcttatcacggtacgttgaggcacacagtacacatgatattgttaaaacaccccttctagaatcattactattatttcaaatgggaaagatctaaagagaagagactgctacccactacctagatcta

SEQ ID NO: 282114 - DNA, 326 bp, Homo sapiens
gagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgagctgagctgagaagggcttctccctaggtctacaggggcaggggctcatatgctggggaccagaggccattgggagcattggggggagagctgt

SEQ ID NO: 282115 - DNA, 2010 bp, Homo sapiens
aagagacaaaagactgcactatagagaaggcatagaagtaacaagaatgaagaactagataatttgctttaaatacatataagttattttacatttcttccatatgaaaccaatttattctgctgagtgatttcacagataaaggtgttacttacttgacttcaccatgacaagaaaaggacaagtttttttaagcagcatctttatgaattttttatcagtggcagatattttaatgggctgcatttttacaaattcctgatatattctggagacctgtggtacatttttgctactctggagatataaattaaattagcatgatgtattgccaaggaccagcacgtggattgtctacattgtgatccatgaggcactgagaggactcggccctcagatacaactcccctgggtagatgcccaggcagaacccagcaaatgtatatgcatctctgggctctgaggacaaaatgccttgagagtaaagggcactttcagggctgccctgaggaggtgctttctggacattctaggaactctgagcaggagcatggctcccatactgtttttccttagggcctgttttgaataatagtgtttttctgaatatataaccaagcattttctctggactggaagccacatttgatccctggttctcagaaatctgggtttggtggttctgtctttatagatacttgtacacatcacaaaatcaccaaatttggggaaatgccaaccatactttgagagaataaatatgagcagttgtgcctacttgcataggggagcctgtgtaaaaagtcagtgattccgtaggctcttttcctgcactaaccagtgcagttaatacctcactttcatgaacagcaaactcatggcaacattaagtgaatcatggccgggcgcagtggctcacgcctgtaatcccagtactttgggaggccaaggcgggtggatcacctgaggtcaggagttcaagacgagcctggccaacatagtgaaaccccatctctactaaaaaatacaaaaaattagccgggcgtggtgcagacgcctgtaatctcagctgctcgggaggctgaggcaggagaattgcttgaacccggggagtggaggttgcagtgagccaagattgtgccactgcactccagcctgggtgacagagtgagactctgtctttaaaaaaaaaaaaagattcatgtccttagattagattgtaacgccactgggcaggtactgtgtctaatgttttgtgtggcacctgtcacattgttagagctcaataaacgttcaacaacaatggacttgtgactgtcaaaatacaaaaagggtctacaaagcatttctctagttttgtatgtattttagtaggcctctttattcagaattattaaacaaggcacaaaaattttaacattcataatcaaaagaggcatttgtatgtgagagaagaactctaaggccagtggtgtgcagctcccagtactgctcatagtcctaatggatgtacttatggtggccacacttccagctgagtgagcacctgaccatagctttctcctaaggcataggatgttaagtgttcagggttctgaagttcagaaaaacagtctcacctgaggaggtttctcttcccaagcacatagctaataaagggctgcaggttttctcctgggtgatgttcccagcagcacaaggcctctcatggcaggacctgaagagctcagcctgagcctgtgctggggtcaggtggctcagtgaactcaatgctgctgaattaacaggaggcccaggattacagatatgagttgttgatcctagaaatttctccagaatttagcaatgtgaggttgagtccctaataatttttcttccacttcattctaatcattttcacttacgaattatagagattatcgaattttttagtggtgatggatggcatggacttctggtacacggtatttagagggtcctctgttgagacttgtgcggtacctttgggtc

SEQ ID NO: 282116 - DNA, 1948 bp, Homo sapiens
aagagacaaaagactgcactatagagaaggcatagaagtaacaagaatgaagaactagataatttgctttaaatacatataagttattttacatttcttccatatgaaaccaatttattctgctgagtgatttcacagataaaggtgttacttacttgacttcaccatgacaagaaaaggacaagtttttttaagcagcatctttatgaattttttatcagtggcagatattttaatgggctgcatttttacaaattcctgatatattctggagacctgtggtacatttttgctactctggagatataaattaaattagcatgatgtattgccaaggaccagcacgtggattgtctacattgtgatccatgaggcactgagaggactcggccctcagatacaactcccctgggtagatgcccaggcagaacccagcaaatgtatatgcatctctgggctctgaggacaaaatgccttgagagtaaagggcactttcagggctgccctgaggaggtgctttctggacattctaggaactctgagcaggagcatggctcccatactgtttttccttagggcctgttttgaataatagtgtttttctgaatatataaccaagcattttctctggactggaagccacatttgatccctggttctcagaaatctgggtttggtggttctgtctttatagatacttgtacacatcacaaaatcaccaaatttggggaaatgccaaccatactttgagagaataaatatgagcagttgtgcctacttgcataggggagcctgtgtaaaaagtcagtgattccgtaggctcttttcctgcactaaccagtgcagttaatacctcagcctgtaatcccagtactttgggaggccaaggcgggtggatcacctgaggtcaggagttcaagacgagcctggccaacatagtgaaaccccatctctactaaaaaatacaaaaaattagccgggcgtggtgcagacgcctgtaatctcagctgctcgggaggctgaggcaggagaattgcttgaacccggggagtggaggttgcagtgagccaagattgtgccactgcactccagcctgggtgacagagtgagactctgtctttaaaaaaaaaaaaagattcatgtccttagattagattgtaacgccactgggcaggtactgtgtctaatgttttgtgtggcacctgtcacattgttagagctcaataaacgttcaacaacaatggacttgtgactgtcaaaatacaaaaagggtctacaaagcatttctctagttttgtatgtattttagtaggcctctttattcagaattattaaacaaggcacaaaaattttaacattcataatcaaaagaggcatttgtatgtgagagaagaactctaaggccagtggtgtgcagctcccagtactgctcatagtcctaatggatgtacttatggtggccacacttccagctgagtgagcacctgaccatagctttctcctaaggcataggatgttaagtgttcagggttctgaagttcagaaaaacagtctcacctgaggaggtttctcttcccaagcacatagctaataaagggctgcaggttttctcctgggtgatgttcccagcagcacaaggcctctcatggcaggacctgaagagctcagcctgagcctgtgctggggtcaggtggctcagtgaactcaatgctgctgaattaacaggaggcccaggattacagatatgagttgttgatcctagaaatttctccagaatttagcaatgtgaggttgagtccctaataatttttcttccacttcattctaatcattttcacttacgaattatagagattatcgaattttttagtggtgatggatggcatggacttctggtacacggtatttagagggtcctctgttgagacttgtgcggtacctttgggtc

SEQ ID NO: 282117 - DNA, 546 bp, Homo sapiens
gcagacatcatatttaatggtgaaatacttaaagttttccccatgagatggaggattagtcaggaacatctattttttttttttggtgagactgagtcttgctgtatcgtctaggctagagtgtggtggcgccatctcggctcactgcaccctctgcctcccagcctaggcgacaagagaaaaactccatctcaaaaaaaaaaaaaaaaaaaagaattcttaacagttttatttgtaatagtctaacagttaatacaaagatatccattaacagtataatgggtaaatgaatagtaatacaaaaaaaatcatgcaggaataaaaatgaataaagcattgctacatgcaacaacaggagtgaatgtcacaaaaatataacgaaagaagccagacaaaaataatacaaactacatgatttcatcacttacataaagttcaaaaactaatctaaagagaaattaggatagaggtttcacctttatgtagagtacaagagacggttctggtaattatcttttcacctgtatccatactcaactgtattca

SEQ ID NO: 282118 - DNA, 6011 bp, Homo sapiens
  misc_feature (5948)..(5949): n is a, c, g, or t
  misc_feature (5960)..(5960): n is a, c, g, or t
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttgtttatnnctaccgcaggnctttttctttatgaatttatcttttcatttcctaaacgaccccccccggcg

SEQ ID NO: 282119 - DNA, 5974 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282120 - DNA, 3567 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctac

SEQ ID NO: 282121 - DNA, 4019 bp, Homo sapiens
tcccaacactttgggaggctgaggcaggaggactgcttgaggccaggagtttgagatcagcctgggcaacatagggagacttggtacaaaaaaattgttttaattaattaaaattaaaatttcaaaagaactctgtttcgaaacattgtgcatttcaggaaacacaggaaagcattgtgtgtttaattgcaatgtttttctttctcaatggtatataaagtgttggattacaatcagtagcataactgaggctcaggaaggttaagttacttgccaaatcattatacagctaggaaatagcagagcagcatttcaacagaggttggctcagttctccagaccatgcttttagctgctgtgttttgtctcatttgtgtatgtagtaaattggagagatacttggtatagtttttaaaaattatctcttctatccttaacagtggactagctaaacttctatcatatttcttttttgtccttaccctcaccttgcttagctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282122 - DNA, 5974 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactatagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282123 - DNA, 3042 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgccatttagtagtaagtcctgggag

SEQ ID NO: 282124 - DNA, 1585 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgagaccgggtctctcgttgtcacccaggttagagtgcagttccatgatcatagctcactgcagccttgaactcttgggctcaagcagtcctcctgcctcagcctccagacagacaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcctaataataagggc

SEQ ID NO: 282125 - DNA, 997 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtaagtgaaccaagaaacaaagtcaaatcctcaagttttgacttagggtagaaagatgaatattagctgaattctgtgcattaaaatcacattttttccagaaaatctagttttggttagggatgggctacaggaatttacaatttaaagttcctcaggaattccattgccatccgctgggctgtgactaccattgggaaaaaagctcttagtgttttgttactttttttgttgctatgcggattttttaaaaatcatggctataaagtcaggtggcttttggaggagaattactacttttct

SEQ ID NO: 282126 - DNA, 565 bp, Homo sapiens
ggagacagggtctcaacctccccactagcctgggagtgcagtggtgcaatcttggctcactgcagcctcagcctcccgggctcaaggaatcctcccacatagctgggactataggcatgtaccaccatgcctggctcatttttgtactttttgtaaagacagggttttactgtgttgcccaggctggtctcaaactcctgagttcaagtcattcacttacctcagcctctcaaagtgctgggattacaggcgtgtactactgcacctggcccagataaatattttctaattgggaggctgtaccttttacaaggtagcagacaagaagcagaaaatttgcagtagatacctgtatcattgtggtggttttttggtggttctttggacacatgtaaacagtgctataatagtggaggaggtggcttatttttaaggaagggggtggttaattgcattagtgttatatatttggcacacttttaattattacattttgtttaaaataaatatgtatttcttctttcagatgtttttatacctatgccagagaacttattagtaaact

SEQ ID NO: 282127 - DNA, 510 bp, Homo sapiens
ggcaggtgtatcgcctgagcccaggagttcgaaatcagcctgggcaacatggcaaaacccatctctacaagaaatataaaaattagccaggcatggtggcacgcatctgtagtcccaactattcagaaggctatggtgggaggatcaccggagcctggaggttgagactgcagtgagccatgattatgccactgcactccagcctgtcaacagaggccttgtctcaaaaaagaaaaaaaatgtaattaaaaaaataaaaatttgaaaagtaccatagaccatacattagatatgtaattaaagtaattggatattgttggttttggttaacagacagaccttccagaacttgatacaccagaatctgccagaataatagctttcatctcttggcttagagagcagagaccatttttcccaatactttatgtaataaggtaagttgaattttccatttgctagtagtaaaacaatttgtttggccttgccaggacctgacaagagtatagc

SEQ ID NO: 282128 - DNA, 6028 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282129 - DNA, 5039 bp, Homo sapiens
taaggtacgaggccgggtgttactagggagagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282130 - DNA, 3666 bp, Homo sapiens
tcgataagggccatagggatatttttcttgtctaattggtttctgggaaagcttcattcaagtcctcaatggtcatctgatcaaatggaattaagttcttcatcttctccactcgataaggccaagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282131 - DNA, 5974 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaccaccatgcagaccattgtttgatctatgctaacttatcaacttggctattc

SEQ ID NO: 282132 - DNA, 2782 bp, Homo sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagaggtaaggcacattttcctacctgacatgtttaattgaaatattgaaggaatatgtttttgaaatgaactttaagtaaaattttgattatttctgtgacatttctaagatgtgtagcattttatatttgctcttataattagatgaacagctcttgagttcaaccttgagctgatcatttttaagtctaatgaagcaagttatttgtagtagggtagaaaataagcatattccataaaggaggaacacttgaaggaaatctgtcttgtcagccatttgggaagttgggagggttgctgagataaagcttctggtcactacatagaagcacattaggtaggctgctttcagtgccctttgcttttctgattcacagagtgtcattggggtcagttcagaagaaactcttattacctgcctggaaattgccatgagataatacagtgagaggtgaacagaatgtgtctgaaggggggatgttgtctaccctgtacatgcatatatgccgtaggggtaacattttaactagcaagtctatggtctctgctgttggcaatggtgactgtgccatagtgcgaagtatttttttccccattaactctatttgtacaacctaacctgtaaaggtagttgtttttcttttgtagtgatattactagttggcaaagttactggatatcttagatttgcaacagggaagagctaaactcgctttggaacttacaagaataaagtatgtagaggtgatggagaaggccatatttcatggcattaaaatacatcaaatctctaaactgtgatggttcttttggatacattttggacttatagtcttgctggactactgcatgtgcaagaactgtaaggcccaactttgatttgtcttgcttgccaatttataatgttgacttaaaatggctttcttgtcatttgaccaacttcattgtttagtgtctgtagattctctgaccatcatcatgactcaatgtcttgtctattgtatgagatactgacttaatgtgaaataaaattttaattatgacaaatgagt

SEQ ID NO: 282133 - DNA, 2131 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282134 - DNA, 2545 bp, Homo sapiens
cggctggtacggccggaagtatgggatctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282135 - DNA, 2336 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282136 - DNA, 2771 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatggtctgtacggggcccctgcttaggcctgccccaccccgagcctctcgaggcactgcccagcccacctcagacctgtctaggtcttgccagcatctgccctcgagtccccagtactgccacacccaatccaacaagcgtctcttgctctcctgcttccttctgtctctttgccccctcagatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282137 - DNA, 2212 bp, Homo sapiens
cggctggtacggccggaagtatgggatctcccggccgggctgactcaagcggaggcgcgcggaacagtcgccgaggcgattcccgcccagctcccctgccctgagacagcctccggtgcttctgctgtgtcccaggaaacaagcctgaagcaagcactcaccatccctcaagaatgtgccctgacctaccttcctcaccacggtggcatcagggccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282138 - DNA, 2092 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282139 - DNA, 2279 bp, Homo sapiens
cggctggtacggccggaagtatgggatctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282140 - DNA, 1896 bp, Homo sapiens
cggctggtacggccggaagtatgggatctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccagcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282141 - DNA, 2002 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgtagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282142 - DNA, 1107 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagccggtgaccttgctgacataggggaggagatgcgcgtaaggccaga

SEQ ID NO: 282143 - DNA, 876 bp, Homo sapiens
cggctggtacggccggaagtatgggatctcccggccgggctgactcaagcggaggcgcgcggaacagtcgccgaggcgattcccgcccaggtagttcagcgccccagtccagctcccggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggtaggtgatgactgggtgggc

SEQ ID NO: 282144 - DNA, 433 bp, Homo sapiens
ggcaggggaagccaagtcacgggcaggccgcagtggttcttgcgtggcctggttttattttcattgtgaaatatcatgctcttatttcagtcctcaaattgttctccactttttgcggagagaggagtttcacaggaactggaaatgtgctttatggcatttgcctatccactctctccaacctgaagacacgttgccaagctcacctacccgaggggcagcccactcccagcccctttgaggcctatacagagctggtggggtcgggggtgccaagccaggccctcccctcccctcggttgttgacacaaagatgaggaagagatggtaggatagtgacgcccagactgtatttgtcctggatataaattactgttgcattcaggcagcgataaatacagaggggcccggtgtgcagggcacagaccccacc

SEQ ID NO: 282145 - DNA, 1161 bp, Homo sapiens
aacttaggctagtagagactccgtggtgatcggccgagggcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282146 - DNA, 2592 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282147 - DNA, 1908 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282148 - DNA, 1784 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtaaaataccaacacaagagagga

SEQ ID NO: 282149 - DNA, 2768 bp, Homo sapiens
cggctggtacggccggaagtatgggatctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatggtctgtacggggcccctgcttaggcctgccccaccccgagcctctcgaggcactgcccagcccacctcagacctgtctaggtcttgccagcatccttgggtcccccagctcctcaggcagcttaggggggcccagcactgccctcgagtccccagtactgccacacccaatccaacaagcgtctcttgctctcctgcttccttctgtctctttgccccctcagatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282150 - DNA, 1900 bp, Homo sapiens
cggctggtacggccggaagtatgggatctcccggccgggctgactcaagcggaggcgcgcggaacagtcgccgaggcgattcccgcccagatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282151 - DNA, 1671 bp, Homo sapiens
tagacggcaatccgtgttgccagaagcctctgtacacttctgtcgaacgggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282152 - DNA, 2331 bp, Homo sapiens
ttgcatttttaatagagatgaggtttcaccaagttggccaggctggtcttgaactcctgacctcaggtgatctgcccacctcggcctcccaaagtgctgggattacaggtgtaagccaccgtgcccggccatcgtaatgtttgaatttgcttttttacatcttccatccttttggagtgtcttgttccctcgtcatagttcagcactgtgaccaccttggggttagacactatggttttatatcctgtacttgatattctcgagtccaagtctcctgatgctcttctctgctgtcgtgtgcatttttaaaaacgggaagcaaacgttcattggcatctgatctctaaggcccaggtgccagggatgctccagggtgagctgcctgattgtgcaggccagctgaggctccccttgggagggacctgccgaagagaggcagcagcgtggggccgggacagtgacctctcctccacctggagccatggccaggggagctgcccctcccagcaacttcctgcccttgctgcctccagtctgtctcctgcccccaacccccacccctcacccctcgccctctgcgtattgttctggaggacagaagtctgtctggggctgcatgaggaccactgtccttcacgtcccgatgttgaaggacgacactgttcccggctttctgggtggtgccgtcagaaggcagcagccctgacaagggggttcccacagcctccctgtggagggagttggcctcctgagacccccatgtgcatctgagaaccatggaggcaagccctctgcagatcttcagccagggtgttgtgtgggtggctccgagggctggaagctggcgagggaacagacctcgctgccccacagcaggctggtcctgcccagcaaacacaggagagcctcggccagagagggctgcagcccagggcccccagcagcactctgggccagcagggttgggctcccattagcacagagcagaagggtgccagtttctatggaatttcagatgaacagcacgtaacagtcagtgtgccaaatacacataaatacggcgttctgaaatttagcacactgggaagtccacatggttcatctgaaaacgtgccagatccaggcagccctgacaggcgctcagccaccctgctggggcctgtgtggccacggcaaggccggcacaaatgcatctattcactgttctcagcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaacaaaaaaaaaaaaaaaaaaaaaaaaaaaaaaaaaaaaaaaaaaaaagaaaaaacagaaacaacaaaaaacaaacaacaacaaagaaacagcgggcgcccgcgcattaaagaatacaccctcgccgggcggagccccacgactcagatacccccacccgcagcatctttatttacagatcagagagcggccaccataaattgggcggcacttctataataaaccaggagacgcgtcgcccctcgcgtctcacccacccgctgtcgagtggaacatccccg

SEQ ID NO: 282153 - DNA, 1268 bp, Homo sapiens
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacggtgagcaacaccaggcccctgacaccctgaggctttgctgggcaccactggatttgacctgtcctcaaaagcagaccagctggatggcccagggcccaggccacacggttgtagagaagagagaaggttctggggagagccagctgttgggctgttgggggcttctttcaggctggcggggaggggaggcagtggccccgatgagggagtcaccggcgctcccagctcccacccggccctgagcccacagccccctgccca

SEQ ID NO: 282154 - DNA, 293 bp, Homo sapiens
gaaggtcagttcacacgaggtataggaaggagtctaacatttatttttttcttaagcctcacctagccttttattcacaccaccaagtctaggttagaatgtatctgagcagtgaaaggaccagaatgcatagttatcaaagggcagtttttcccttgctaaaacctaaattcattttttagactctgctagcagttttagatataatgttacaacatgtgttttgttctccaggacctgatttaaataaatgtgataaaaataggctaagttttttgtcatccagggctgct

SEQ ID NO: 282155 - DNA, 2242 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282156 - DNA, 1382 bp, Homo sapiens
tgcccatgagacaggcaggacaaggattcttttatatatttatacacacacacacacacacacacacacgcacgtttatatatatttttggtagagataggatcttgccatgttgcctggactagcctcaaactgggctcaagtgatcctcccacatctgcctctaagtagctaggactacaggctcacaccaccacaccgggctaattgttaaaaattttttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcagaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282157 - DNA, 1343 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctttactaaaaatgcaaaaaattagccaggtgtggtggtgggcacctgtaatctcagctactcgggaggatgaggcagg

SEQ ID NO: 282158 - DNA, 800 bp, Homo sapiens
tcaccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctttactaaaaatgcaaaaaattagccaggtgtggtggtgggcacctgtaatctcagctactcgggaggatgaggcagg

SEQ ID NO: 282159 - DNA, 742 bp, Homo sapiens
tcaccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccacctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctttactaaaaatgcaaaaaattagccaggtgtggtggtgggcacctgtaatctcagctactcgggaggatgaggcagg

SEQ ID NO: 282160 - DNA, 2780 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282161 - DNA, 2936 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggtctcgctctgttgcctaggctagagtacagtggcgccatcacagctcattgcagccttaacctccagggctcagagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282162 - DNA, 3545 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282163 - DNA, 2625 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaagcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282164 - DNA, 2945 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282165 - DNA, 2200 bp, Homo sapiens
ctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgcacaccttcgcctccgattccgaaccgcccggggacagaggcaagtggcaaagcagggagggcggaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282166 - DNA, 1697 bp, Homo sapiens
cgagtcttgctctgtcgcccaggctggagtgcaggggcgcaatctcggctcactgcaagctccgcctcccggttcacaccattctcctgcctcagcctcccgagtagctgggactacaggcgcccaccaccacgcccggctaatttttgtattttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282167 - DNA, 2720 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcaggggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282168 - DNA, 836 bp, Homo sapiens
ccccctggtcccctcaggccgctgggttgcagtcctcttaggaaggtctctctctgcctttcgagcctggctgcgctgctatggcatgccaggcatgagctccctgcaggaccggcatggccgtaccatctggttccagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282169 - DNA, 3085 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggtgggctttcctcatcactcccagaaactggctctacaggagaggatgggatggtggcctaggagcgcgtgtacaaaggtgggagaaaggctgccatggcagcccctggagtcttagctgaccatcttgcctgttcttcccccaggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282170 - DNA, 3339 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttcttggcacctcttggtctgagatggccaggtaggaagggcctgctgtccggtcctggtgacagaaggcccagctcctcacaaggcaaactgagcccccatcccagtcctcaaggctctgactctatcagaggacagtttgcctctgcaaggacagcccctcagaggtggtacaaagaccctggccccaggcagcccaggagccagagctcctccagtccagattctccagggtccagggctgccccctcatcctggcaggagccaggcaaaacccacccttcggcccctccccagccccaggcccaggccctttacctgctggcacaggggaggggcttctcaactcatggtctcttcactggcttttggtggctcgaggtccccagtctctcctgtggg

SEQ ID NO: 282171 - DNA, 744 bp, Homo sapiens
tcaccttgatgttcccatttaacagataggaagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctttactaaaaatgcaaaaaattagccaggtgtggtggtgggcacctgtaatctcagctactcgggaggatgaggcagg

SEQ ID NO: 282172 - DNA, 194 bp, Homo sapiens
cagccgcagctggccacatgcccatctgaccctccgagttctcctctaaaaatggggctgacagccgctacctcacaaagtccacaccgggctcaacccgctgccttcctccccaacaggactctgccaccctccctcaggatgcctgagggccccgagctgcacctggccagccagtttgtgaatgaggcctg

SEQ ID NO: 282173 - DNA, 1870 bp, Homo sapiens
ctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282174 - DNA, 3105 bp, Homo sapiens
ctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282175 - DNA, 2346 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282176 - DNA, 2473 bp, Homo sapiens
ctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282177 - DNA, 2821 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggcacaccttcgcctccgattccgaaccgcccggggacagaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282178 - DNA, 2940 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282179 - DNA, 1924 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccgggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcagaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 282180 - DNA, 1920 bp, Homo sapiens
gttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctttactaaaaatgcaaaaaattagccaggtgtggtggtgggcacctgtaatctcagctactcgggaggatgaggcagg

SEQ ID NO: 282181 - DNA, 978 bp, Homo sapiens
  misc_feature (740)..(740): n is a, c, g, or t
  misc_feature (766)..(766): n is a, c, g, or t
tcaccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccactggcacctgtgaacccttctctacatgcacaatacgggtggggnccgtgctcaaccgggggtgcgcaacntacctggtggtggacgacgtcgtcccggtacgtacccttccgaccacagcagcaacaacaaccaacgaacacacacacagacacacccagcacgcgacacgacaacacaaccgcacaagaccacaaccaccaagaccacacaacagcacaaacacacacagaacgaaaccgacaaccagaacatagagcagtagaacggagccagacgccac

SEQ ID NO: 282182 - DNA, 1250 bp, Homo sapiens
ttaattattgattaattttattttaattctgtactcttaccaaggtgtaatacatgtacattgtattttatgatctgctgaagtcttttgtacttttgctttgaaagtaaattttacaaattatatattctcaaaatataatggagaggacttccaggtgggacgaagtagctctgtacagatcagcactctcaataagaacaactagaaagctaaataaaatatagaaatctatttgaaggcatttgctatctatggaagaaatgagaactgggaggctgagaatcaagaggagaaaacctcaaggagaggagctgatgtctgcagctgctcctaccctggggacatttgcaaatttagggtacaggagggaggctgagaatccaggctatgcacagtcacaaaactgctgctgaggcttagaggaaccattggagcttttggcagagtgttgagagacctcaaacatgcagccagctcctctcaagactttgatgaattctggcgtagcccaggtcagaagctaaaaattaagaaaacgcctctgaaaagcagagcaaagcaatcagcagtcttgtaagacaacatttagaatttgagatccacactgcttgtgtgtttaaatatttgacaaacgacagagaattctattctgaagtatgttgtgggccaaggcacttagaattgtttaggaacactggccactccaatctcccaagtaaaaccctgaagagcactatcccagaacagaagtgaaccagaagtgaacagactcttaccaaagccataaactagcttcgactcagcaaaaaccctgactggattaaagtgaccatccaatcacatcagcctatgtccctatcagaggggacagtaaaccctctctctggaagaagactgcgttatctggagcctctgtagttttttaactggaatgtctgacattcactcaaaactaccagaaacaccaaaaacagaaccacatgatggataaccaagaaaaaagcaaacgaaacacacacagaaaaatcaaaggatattccagatattaaaattagctcacatggactggaaaacaaatacaattaacacaagcaagaaagtggagaaagccatttagatatagatgaaaagataagttaaccagataattggaatttacagaaaataatcaaatagaattgtaaaactgaagaacatattctctaaaattaagaactcatgaggggccaggtgcagtggctcacgcc

SEQ ID NO: 282183 - DNA, 1095 bp, Homo sapiens
tcctgctctttcaagggagtgatgtagagaagaggaggcgacaaagagcggatggatgacgagagacgaccaaccaaagacaatgggcatttgctatctatggaagaaatgagaactgggaggctgagaatcaagaggagaaaacctcaaggagaggagctgatgtctgcagctgctcctaccctggggacatttgcaaatttagggtacaggagggaggctgagaatccaggctatgcacagtcacaaaactgctgctgaggcttagaggaaccattggagcttttggcagagtgttgagagacctcaaacatgcagccagctcctctcaagactttgatgaattctggcgtagcccaggtcagaagctaaaaattaagaaaacgcctctgaaaagcagagcaaagcaatcagcagtcttgtaagacaacatttagaatttgagatccacactgcttgtgtgtttaaatatttgacaaacgacagagaattctattctgaagtatgttgtgggccaaggcacttagaattgtttaggaacactggccactccaatctcccaagtaaaaccctgaagagcactatcccagaacagaagtgaaccagaagtgaacagactcttaccaaagccataaactagcttcgactcagcaaaaaccctgactggattaaagtgaccatccaatcacatcagcctatgtccctatcagaggggacagtaaaccctctctctggaagaagactgcgttatctggagcctctgtagttttttaactggaatgtctgacattcactcaaaactaccagaaacaccaaaaacagaaccacatgatggataaccaagaaaaaagcaaacgaaacacacacagaaaaatcaaaggatattccagatattaaaattagctcacatggactggaaaacaaatacaattaacacaagcaagaaagtggagaaagccatttagatatagatgaaaagataagttaaccagataattggaatttacagaaaataatcaaatagaattgtaaaactgaagaacatattctctaaaattaagaactcatgaggggccaggtgcagtggctcacgcc

SEQ ID NO: 282184 - DNA, 1282 bp, Homo sapiens
ttggtgcccaggcagccacttcacctaccttgtttaccagcctgggcagagaccggagctagcccacacgctcttggccaaggacggcagcccgcagagctctgaccagcttggccagagggaatgcagctgattccccctgctctgtgcccgacccgtgttaaagtttaacccggcttccaggtctcctcttttccagacaggggcgcagggaaggagcgcccggcgagactgacgctccggctccacgcccgcctggctctgggctgtcggttaccctgtaattacctgacagctctgactgggcttaggaaccggtgagaaacctcagtctcatctctggtatctggaggaaggaagggaaataaagaggcattttaaaaatgcggactcaccagttctcaacctccccggccggtgtgtgggaaagggcggcggccgggctggctgggcctggggcggggcgagccatccccggctcgggctccggggcccggcccactctccacaggccccgcagcgagggcgtggctcccaggttccacgtcctgcgagaggggaccatggcctggggctcagcagcctcctcggggcaccaggcagcctgcggagagaacaaggggagataagcttgaagaccgtggaccagcacaactgcacctcgggcagagccagccatctggaagggtctacgccccaccggtcgctggttacccagcgcagcagctccaactgcactgtcccccaaagaccctagggctcgcaggatgaaatggggcctgctgcctatttgggggtatttgtttccgaatacggaggctccgaagtgcgaaagttgcatatcagctgtgcctgagaccccacacctgagcccttcccagctgagcctggagcctgaggacaagccaggtcctagccccacacagaggaggcaccgcgagtcagcagcatctccaagctgtattaacaggggaaaacagttctcccattttcagagaaccaaggcaatctttcccccaagaaaatcaccttgccggccaggcacagtggctcatgagacaggaggatcgcttgaggccaggagttctagaccagcctgaacaacatattgagaccctgtctctacaaaacaacaagccaggcgcggtggcacaggcctgtggtcccagctactcaggaggctgaggcgggaggatggcgtgggcccaggagtttgaggctgcagtaagctatgatcatgtcactgtactccagcctgggcaacagagcaagatcctgtctt

SEQ ID NO: 282185 - DNA, 4462 bp, Homo sapiens
  misc_feature (1118)..(1118): n is a, c, g, or t
  misc_feature (2545)..(2545): n is a, c, g, or t
tcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaatggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctgctgctgtgagcaggaggagcccacatactttgccatctggggcgacaacaaggccttcaatgaggtgatcatctcgccagccatgctgcatgagcacctgccctatgtggtcatggaggggctcaacaaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggagcaagtcccagtctgagatgagcctggagggcttctcggaggggcggctgctgtcgccagtggttgcggcggcggcccgccaggacccggtggagctgctgctgctgtctacccaggagcggctggcngcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccntcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccaccttgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagcacaaa

SEQ ID NO: 282186 - DNA, 744 bp, Homo sapiens
ggcacggtggctcacgcctgtaatcccagcactttgggaggccgaggtgggtggatcacctgaggtcaggagttcaagaccagcctagccaacatggtgaaaccccatctctacaaaaatacaaaaattagccggacatggtggcagacgcctgtaattccagctactcgggaggctgaggcaggagaatctgaacctgggaggtggaggttgcagtgagctgagatcacgccattgcactccagcctgagcgacaagagtgagactctgtctcaaaaaaaaaaaaaaaaaaaaaaaaagataatatcactagttttatgtacttcacaaagttaaagtaaggataaaaataaaatgatgtatgtacatgaaagtactttttacatcatatagaaatgtaaagtattaatagtaacaataattttgataacccaaaatgcttttatctgcattattaagattttctaaagtatcctgagagggacaatgcctctgagttttaaataagcaagtaagtcaagagctagaaaaagctgtagttctggtgttagcagaactctgggtttctgatttagccaggggttcaaaggcagggacagatcaatagagctacctactgggcaagtgaagggagaaaggaaaaagcttcctattcttaccctttctttctccatactgtccataaaatcctaaaacattccagaacaggataaagagattatcttttctgtttctccaattaag

SEQ ID NO: 282187 - DNA, 731 bp, Homo sapiens
tgactccaaagacagtgctgttgggactgtctggggctcctcatctgtccaacccaggaactgcttaccatgccaatcaggaagagggaagccagggaggagttggggaggacggcaaaggcctggacatccacggcagggtagaaggtgataacacagcctgcatcgcgaatccaggagaaaaggatggtcttcccaggaaatggtgccagaataactcgctattcatatggaagaaaatgaaaatgattccgtatgtcatcccacacattaaaaatccattccagatggattaaggatttaaatataaatgggatgcccggaagaagccttgcatctggatatcagccacagacacggagatactcaaagaagcattgtgcacctggagagaaaccagatcgccattaacaatcgaacatagaaacattggctgggggcggtggctcacgcctgtaattccagcactttgggaagccgaggccgggcggatcacttgaagtcaggagttcaagatcagcctggccaacatggtgaaaccctgtctctactaaaaatacaaaaattagctgggtttggtggctcacacctataatcccagatagtcaggaggctgaggcagaagaatcgcatgaacccaggaggtggaggttgcagtgagctgagattgcgccactgcactccagcctgggtgacagagcaagactctgtctcaaaaaagaaaatagaag

SEQ ID NO: 282188 - DNA, 468 bp, Homo sapiens
ggagtactgtcaggtttctagggcataaggacaaaatcaggagtttcattcacatcctcccttacgcataccagtcaggcagctatgacaaatatacaaaagagcaatgagagaatatgggggagagggatttggggaagcttatgcagaagatgagttctaagcaggttttgaaagacgggtaaaattttgacaataatgagggaaaaggcatgctaggttgagcagacaagacccaaggtaaggacatgagaaaggcactttctggggaaggtgtctgagaaatggcaagtaatctggaatgaataaggcacaatgaagaaactggaaaggtaagctgtgggcagatcagggagactcctgaatgtcagtttaaatttggattttatcatacatatggtagagtgataccttctaaagcatacatttgtccagtagcaggataggctgtaggggaaagggaccaaa

SEQ ID NO: 282189 - DNA, 382 bp, Homo sapiens
gggctgagattcaggctcaggtctaggggttggggaatattaaagtttacaagtacaatcttactccatccatacacacacatggagaagccaggagaggacgcggccagagatgggctcctgcccttgaacccctgctggggtggaagcaggtgcacaatgcttctttgagtatctccgtgtctgtggctgatatccagatgcaaggcttcttccgggcatccctgggaatgggagtgcatagacatactggtcaaattacagcacagcctctacacctttactgaagatggaaaactgttttccaaagttgacttgcctaacatgatgtaactatcatgcaaaaataaaaataaaattaagaataaaaatttaaaaatga

SEQ ID NO: 282190 - DNA, 659 bp, Homo sapiens
aatattgtattgtattgccattttaatataggaaatgttgaataagaatctacaacaagaaataggcaccagacagtggcaatgagaaaagtgaggatccatgccttctggacctctcagtacactctgcctaccacagcacctgaaacaaggcacacattaatgcaaagctgtttagttgggaatgaaccacttaagaggctcttcgagcaaaaacatcagtctatgtagcagacgtaggtccatgaagactgtcatcttgactccctagaggattataacctctgaatggattctttcatgagtatttatcatccttaaaaccctgatcagaaatatcaaatgatcatagttgcaacgtgcctgcttttgcaccattgacagccagtattcgcatcttgagaagagagagtttcattgatgaaagagtatcaacagtatgtgaggaacactagcagtgcttctgaggacaagactgtgctggacaatgggcttgtcccacgatgcgggaaggatgggtataccatgggaagaggaaagaacagggcttgatactcctccagctaattaatgaccaggggaaaaggaatgccagtcacggcccacctagggtgcatttaagcacataacatagacaacaaaaactgaaggtattgaga

SEQ ID NO: 282191 - DNA, 1045 bp, Homo sapiens
aatattgtattgtattgccattttaatataggaaatgttgaataagaatctacaacaagaaataggcaccagacagtggcaatgagaaaagtgaggatccatgccttctggacctctcagtacactctgcctaccacagcacctgaaacaaggcacacattaatgcaaagctgtttagttgggaatgaaccacttaagaggctcttcgagcaaaaacatcagtctatgtagcagacgtaggtccatgaagactgtcatcttgactccctagaggattataacctctgaatggattctttcatgagtatttatcatccttaaaaccctgatcagaaatatcaaatgatcatagttgcaacgtgcctgcttttgcaccattgaataaacaaggaacaccaatgagaaagaaagcacgttttcaattaccttggaaactcggtttgcaacttctctgcccacagtcagcccctggacaaaggtcctggcagcaatgaaggcgcgggtaacctgaatcttcagtttccggggcacgtctccaaatggcttgagctggtcagtgtatttgctcacacattccaggtagtcttcactgaagtgatactgagggtttatcagctgaaacatccgttccaggagccgagcccaaaagtcattgagcatttcctccagattcacattacccccagtgtagtaccttttcagctctgtgaagaggtcctggaagacttctgaattctgcatgtacagcatgccataggtccgtacaaacatatcatttagtgacttttctgcattctccaggagctctcggaaaaattctgcagataaaacagaaagaagtcataaattaatgaaatctagaaagcccaaggcacccacttaccttaagtacaactgcttttaattgacattttcatggaaaaacatatcctgtgattaaggtgttaatggacagataaaaaacatattttaaatgggatttgacctacatctatgaccttgtacaactcaaaacagaataccccatgatttccattaacattag

SEQ ID NO: 282192 - DNA, 818 bp, Homo sapiens
cttgagtccaaaagaggagagaaatcgcaccccgagaagaaggcgcgagctcggtggctccagtcctgcgggagcagaggggacagcagacctgcccaggtagagggagacgacttctgaggtgctggaggctatttctggattttgcgcggcctggcgctgggtgccacagccggtgaatgcgggagacctgcagcagacccggcgctgccgccagaacctgctcactacgctccacacagctcgtcagggcccaacctgagcactccgcgggcctgcggggatggggcggaaaggctggctgctgtcttcggaccctgaaccctcccctctttttctcttttcttcatgtctacacaaaggcagaatgggcaggctcactcgcaggccgacgccaccgacgtgacgctagtgattttggtcgagtcgtcagaccacggctgcagattctgcagggcgaagagcgacgagttgtgcacgcacagagggtcagcgggcagcggctgtgccaggctcttctggaaggcctcctgctgcaactgcaggaggatgcggttcgcttgctgcctctcggcctcccgttcctccgcagtctgccgtctgcaccgggaacaagccgttacctgccaggagcaccgacccagctcccgcgtgtgcccaactcctggtgcgttcccaggagataaactgaacgagcgctgctcgcctttgcagtccccaaatccagtttgggcccctataacgcgttcccttcttttgagagtcctgactccaacaaagactggaaaccccaaagcggatggagccaaggtatccca

SEQ ID NO: 282193 - DNA, 1212 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcagggtgagggccagccacgtggaccttggaggaagcaggagacttgctgtagggcctgggcccacttggcaggagcagcacaaggcctccaggggtcaaacagggatggggcccagtgtcccgggaaagcatggccttagacaggagcatgcccagcacatccacagccaagaagggaggcagaggactccctagggtgggctggaacctatgggtaggagtgcttttctcatggtttccctttctagcagcttttccttgaaataagaactaaggccaggtggctgacgcctgtaatcccagcactttgggaagctgaggcaggtggatcacttgaggtcaggagttcgagaccagcctggccaacatggttaaaccctgtctctactaaaaatacaaaaattggccgggcgcagtggctcactcctgtaatcccagcactttgggaggccgaggcgggcggatcacgaggtcaggagattgagaccatcctggctaacacggtgaaaccccgtctctactaaaaatacaaaaagattagctgggcgtagtggcgggtgcctgtagtcccagctactcgagaggctgaggcaggagaatggcgcgaacctgggaggcggagcttgcagtgagccaagatcgcgccactgcact

SEQ ID NO: 282194 - DNA, 1420 bp, Homo sapiens
aacaaaacaaaacaaaaaaacagctaagactttcaactaagcatcaggatgggaggaggaggtgttggggttttgaggagtgacctcagctgagcacctgtttcccaataataactcctccaatttgtatttgaggacccccaatgatgctcagagaggttaagtgatttgaccagggtcacacagcttgagggaatggggtagctccaggattgaagcaggccatttcatgctctcagccaggtatgatttagtaaatacagaagcagagtaccttcatggtgtctgggacatagtgagtgctctgtagcgggttgtcagtgaaaagactgagtggcacgtccagtgtattctgtttaataccacagaggcgtagccacagtgtttggaagtccttggtcccttccaccaatgattaagtgctggctgtgggaagactggctcctggggaggggaggtgggctcagcaggtggccctggtgtagcgtaaccttcaacctggcacacctgggacagccttggatgttggggccactaacctggcacataagccccttctctctcccagtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctgtatcctttgcctgagcccagggcccgtggggatgtgtgggttctgtgggtgggtgcctgggaaggaagtggcacaaaggggtgaaggcccaagcaataccaaggagccgtgcacacacattccaggagcttctctgagtcttcctctgggacatgctctgggctgggacctggggtcttatggcctggtggaggtgccaattacaatgtaaagggctacgtgggctccctgtaatatcaatgccattcttcgcagaaatagaaacaataaccctaaaatttatatggaaccacaaaaggcccagaatagccaaaccaccctgagcaaaaattaaaaattaaaaaaattaaaagcctgaccgggcgcaggtgtcacgcctgtaaccccagcactttgggaggccaggcgggcagatcacttgaggtctggagttcaagaccagcctggccaacatggtgaaaccccat

SEQ ID NO: 282195 - DNA, 1997 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcagggtgagggccagccacgtggaccttggaggaagcaggagacttgctgtagggcctgggcccacttggcaggagcagcacaaggcctccaggggtcaaacagggatggggcccagtgtcccgggaaagcatggccttagacaggagcatgcccagcacatccacagccaagaagggaggcagaggactccctagggtgggctggaacctatggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282196 - DNA, 1793 bp, Homo sapiens
aacaaaacaaaacaaaaaaacagctaagactttcaactaagcatcaggatgggaggaggaggtgttggggttttgaggagtgacctcagctgagcacctgtttcccaataataactcctccaatttgtatttgaggacccccaatgatgctcagagaggttaagtgatttgaccagggtcacacagcttgagggaatggggtagctccaggattgaagcaggccatttcatgctctcagccaggtatgatttagtaaatacagaagcagagtaccttcatggtgtctgggacatagtgagtgctctgtagcgggttgtcagtgaaaagactgagtggcacgtccagtgtattctgtttaataccacagaggcgtagccacagtgtttggaagtccttggtcccttccaccaatgattaagtgctggctgtgggaagactggctcctggggaggggaggtgggctcagcaggtggccctggtgtagcgtaaccttcaacctggcacacctgggacagccttggatgttggggccactaacctggcacataagccccttctctctcccagtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282197 - DNA, 1591 bp, Homo sapiens
aaactcctgggctcaagcgatcctcttgcctcagccacttgagtagctgagattacaggtgtgcactgccacgtccagctaattttaaaaattttttgtagagacggggtctatgttgcccaggctggtcttgaactcctggcctcaagtgatcctcccgtctcagcctccccaagtgctgggattatacagctgtgagccactgcgtccagccctaagatgattcatacctatcggggaaaacagtgccactggagagaacaggctggcctctgcactctggattggtgacaggagttatccaggcctgtctgaaggcaatagcaggtgtgtccatgggacttcttccaggacgggtgggtcttgagttacagacctgaaaaggtgcatagggttctgggaacagagtgggtcacgggtgagcccaggccttggggtgaggcatacctggctctgtttggctgagtagcttcaggcagatcccttttcctttctgagcctctgctgctgaccagggtgacgctattccatgctggtccacagtgaggagacgggagggaatggtggccagcacacttggcatggggcctggcctgtggcgtgggcccacccctggctgcttttggttttccttgaccggccgccctgccccgggcagacagatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggtgagggtgatgggggggatgccagtccaggtggtgggcactgtggcagggctgccagtcaggccctcttctcttcccactcctccaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282198 - DNA, 1595 bp, Homo sapiens
agccaagtagatgaagttctcatttaacatcatcattctttaacagagcgtttattgggcttctactatgtcagacactggggatacatgagacacacaagatacagtccccaagaagatgtatgttgggtgctgaggagagagcttccctgcatcccttaattcacataatattccagttccaactaaaaggagataagactcgttctctgtactcccaacaagaaagtgacaagctgatttttaagaacatgatttcaaatctgattttcatgacacagcatctccatcctaaagtcaacaggcccattttcccagccttggatgttggggccactaacctggcacataagccccttctctctcccagtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282199 - DNA, 1447 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282200 - DNA, 1413 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctgtatcctttgcctgagcccagggcccgtggggatgtgtgggttctgtgggtgggtgcctgggaaggaagtggcacaaaggggtgaaggcccaagcaataccaaggagccgtgcacacacattccaggagcttctctgagtcttcctctgggacatgctctgggctgggacctggggtcttatggcctggtggaggtgccaattacaatgtaaagggctacgtgggctccctgtaatatcaatgccattcttcgcagaaatagaaacaataaccctaaaatttatatggaaccacaaaaggcccagaatagccaaaccaccctgagcaaaaattaaaaattaaaaaaattaaaagcctgaccgggcgcaggtgtcacgcctgtaaccccagcactttgggaggccaggcgggcagatcacttgaggtctggagttcaagaccagcctggccaacatggtgaaaccccat

SEQ ID NO: 282201 - DNA, 1786 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282202 - DNA, 1718 bp, Homo sapiens
ggcccgggccagcggggaagggtccccaaggccggtcggctgggtgggaggcctcgaacgccgtgcctggccccgagaccctatccccggtaacggtcgaggtggagcaggccctttaatcatccctcatccgatatccttgtttctacagaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282203 - DNA, 2088 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaaggtaggcagggcctggtggtgcactgccccgtttcatagattgaagaaagtgaggtccagggggctcaagtcccagttccgagtgtccacggcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcagggtgagggccagccacgtggaccttggaggaagcaggagacttgctgtagggcctgggcccacttggcaggagcagcacaaggcctccaggggtcaaacagggatggggcccagtgtcccgggaaagcatggccttagacaggagcatgcccagcacatccacagccaagaagggaggcagaggactccctagggtgggctggaacctatggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282204 - DNA, 1643 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcgaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282205 - DNA, 1544 bp, Homo sapiens
tcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcgcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcag

SEQ ID NO: 282206 - DNA, 2797 bp, Homo sapiens
agcgggtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgtacgtgtgctctagtcctccccgcccgctcgctgcctccgagtctcatgaagaaagctcggaacacctgctccacggccacatccaggagtggcagggggctggagagtaattattattttggccttatgcaactgaaaagcagggttcgttattacccgaagaggaggaggagtctggggcagttaattatataatgctcctgcctgtcaaagccgtgcccagccccggtctcaggcggccttttctgtgccgttgttgttttcatggagcaggttggagagcttccctgaccctggggcgctgagggccgggcgggagcagacggtgctcccttggttccaggctgtgggcctgtgtgtgtgtgtgcgcgcgcgtgcaggcacagggaggcccgggcagcagatgtgggtggctgagacaggcaggcagcctggcgcttccagctgggctgtttggagcccaggggctgctatcacccccaggctctggccaggaggctctgcagacctgtcctccagaggtgctcctggctgagcctgctccaggaggactgtgcaggccgggctcacgcagggcatggggacgagaggagccagggctttcgttgtctctgaaactcctcagaatatctgggggtgaggctgagcaccccactctgcccacgctcctcagacatctccagagtcctgaggaatcatttctttcattcaacaaatactgatggaatgtttgctatgagccaggtgtgccaggctctgggaaaaccacactgagcaaagcagacagccaggtgtcctaggctttggaaaaaccacactgagcaaagcagacacagatctttgccctcacggagcttacatttgagggagaaggagcggcgattatgttgtgactttttagggaagaaaggatctgattctgtggctggccgtgtagtttaggatctgacgggttaaggggagagatgtttttctctataggtccacttccctgggctctccactccagccagacagctccctcagcatcctgctcccctaagcccttcccctccttgtggtcctgcctgatcatgtccattctacagatgaggccagtaaggcccgggctttgtgattcaggagtcccagcctttggctgcagggatccccgatctgtctgggaccaaacccccctcgttcttgcatcacattgccggaagaagcccagattgtcaacatcctctcaaggggtatgcggttcttagctctcccataagcaaagccaggcagggatgcagatggggagcttcatggccggctctcccttttggttggcaacatggcatgacaggaaatagaattgacccttctggtcttgaggactcgggcctggacatctgggccacttttctggagggctcccagcttcctgttgggaagggggtgattatggcactgagtgtccccaggcagcccatggaaggagcctgcagggtgtggggatcgccagaatggggcagagacctccatgcctccttcccagtcaactggtgggtggtgacagccatgtcgcagtgaggaaggagttaatggccccagctccactctgacttttcctttgcacaagaagtg

SEQ ID NO: 282207 - DNA, 4167 bp, Homo sapiens
agcgggtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagttagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcaaaaaaaaaaaagggggcgctagagtcccccggggccaagctacccgtcccgttctgtccggggcccatgggatcgattaagcagccgcgggtacagccgcggaaccgccggctggggcccccccggggctggcccccggagccggaaaaagtgggccccctggggtctgtacccccc

SEQ ID NO: 282208 - DNA, 1184 bp, Homo sapiens
agcgggtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgta

SEQ ID NO: 282209 - DNA, 1033 bp, Homo sapiens
agcgggtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagatgccaccgcattcggggcagagccggggccggaagccagggagctgcctgctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgta

SEQ ID NO: 282210 - DNA, 253 bp, Homo sapiens
gctcctccctgtctcccccaggacctcccactctcgggcaaaggccgaggcagccctcacagcagctcagaaagcccaggaggaggcgcggatcgccaggatcactgccaaagagttctccccttccttccagcaccgggaaaacggtgagtctcgccgggcctgatactggcatcgtgggaagggggtgcgtggatggctgggcagtcctggcagcagatgtgtcctccagagcgggtaggcttagatgggc

SEQ ID NO: 282211 - DNA, 901 bp, Homo sapiens
tgctggggctgacaggctccaaacaggacaacatcttgttgatgggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcaaaaaaaaaaaagggggcgctagagtcccccggggccaagctacccgtcccgttctgtccggggcccatgggatcgattaagcagccgcgggtacagccgcggaaccgccggctggggcccccccggggctggcccccggagccggaaaaagtgggccccctggggtctgtacccccc

SEQ ID NO: 282212 - DNA, 3990 bp, Homo sapiens
agcgggtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagttagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagca

SEQ ID NO: 282213 - DNA, 2952 bp, Homo sapiens
agcgggtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattggggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagca

SEQ ID NO: 282214 - DNA, 1004 bp, Homo sapiens
  misc_feature (997)..(997): n is a, c, g, or t
  misc_feature (999)..(999): n is a, c, g, or t
  misc_feature (1001)..(1001): n is a, c, g, or t
  misc_feature (1003)..(1004): n is a, c, g, or t
tccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggcagacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacagggcgaacgctgttggagaagctgttcagccagcaggagaacgggcctccagaagaagcagagaagttttgctcccggatcattgccatgggtcttctccttccttttagtgattgcttcagggaaccgtgtaatcagaatgcccagacgaatgcagcttcgtttgatcaagatcaactttatacctgggctgcagttagtcaacccacacactcattggactattcagaagggcagtttcctaggcgagttccatccatggggccaccatccaaacctcccgatgaggaacacaggctcgaggatgctgaaacagaatctcaatctgctgtttcagaaactccccaaaaacgctcagatgctgtccagaaggaagttgttgacatgaagtctgagggacaggccactgtaattcagcagctggaacagactattgaggatctgagaaccaaaatagctgaactagagaggcagtatcctgccctggacacagaggtggccagtggtcatcaagggcttgagaatggagtgacagcctcaggcgatgtctgtctcgaagctctcaggntngngnn

SEQ ID NO: 282215 - DNA, 400 bp, Homo sapiens
cgtccagcaggtagaagaggcccgtgggtttcttgctgatgagatggatgcagccgacattgtctgtgtagccgatgttgtgccacgtgatcccctcgccctgatattcctcctgcaggggtggcgcggggtcgagatcgacagacgctatgctgtacaggctagtctggacctcctggcctcaagtgatcctcctgcctcggtctcccgagtagctgagattacaggaggaaacgtagacatggcgtggcattcagagattcctgggaaaacattctcctacctctcatccttctcctgagacaccaggcgagacttttcaagcagatatttctcgacgacagctctgtcattaagagaaaaacagaaagaataaaacattacattttagtattgtgtt

SEQ ID NO: 282216 - DNA, 496 bp, Homo sapiens
cgtccagcaggtagaagaggcccgtgggtttcttgctgatgagatggatgcagccgacattgtctgtgtagccgatgttgtgccacgtgatcccctcgccctgatattcctcctgcaggggtggcgcggggtcgagatcgacagacgctatgctgtacaggctagtctggacctcctggcctcaagtgatcctcctgcctcggtctcccgagtagctgagattacagtagagatgaggttttgccatgttagccaatctgatctcgaactcctgacctcaggtcatccgcccaccttggcctcccaaagtactgggattacaggaggaaacgtagacatggcgtggcattcagagattcctgggaaaacattctcctacctctcatccttctcctgagacaccaggcgagacttttcaagcagatatttctcgacgacagctctgtcattaagagaaaaacagaaagaataaaacattacattttagtattgtgtt

SEQ ID NO: 282217 - DNA, 506 bp, Homo sapiens
tttcaggtgctatcatgttagaggtctctgatctctgaagatctttgcttaaaggaagtctgccttggcctttgagaaactgctctctggagtacagcccacctagtgaatatcaagcagtgtttcaaaagcactggacatctcaaaagggagattcaaggtcaagtgtgggccctcatttcagtgtatcagtggaaagaaaaaaggcgcaaattcattcctccagagactgggatgcaaatgggagttatctctgaagacaaaggaaagggttacctgtttcagcatcctcgagcctgtgttcctcatcgggaggtttggatggtggccccatggatggaactcgcctaggaaactgcccttctgaatagtccaacgagtgtgtgggttgactaactgcagcccaggtataaagttgatcttgctatatttaaaaataaaaaatgttgaaatgctattaattcagttacaaaaaaataaaccatgactaatacattgcaaaatca

SEQ ID NO: 282218 - DNA, 347 bp, Homo sapiens
tttcaggtgctatcatgttagaggtctctgatctctgaagatctttgcttaaaggaagtctgccttggcctttgagaaactgctctctttatctctgaagacaaaggaaagggttacctgtttcagcatcctcgagcctgtgttcctcatcgggaggtttggatggtggccccatggatggaactcgcctaggaaactgcccttctgaatagtccaacgagtgtgtgggttgactaactgcagcccaggtataaagttgatcttgctatatttaaaaataaaaaatgttgaaatgctattaattcagttacaaaaaaataaaccatgactaatacattgcaaaatca

SEQ ID NO: 282219 - DNA, 700 bp, Homo sapiens
  misc_feature (672)..(672): n is a, c, g, or t
tttcaggtgctatcatgttagaggtctctgatctctgaagatctttgcttaaaggaagtctgccttggcctttgagaaactgctctctggagtacagcccacctagtgaatatcaagcagtgtttcaaaagcactggacatctcaaaagggagattcaaggtcaagtgtgggccctcatttcagtgtatcagtggaaagaaaaaaggcgcaaattcattcctccagagactgggatgcaaatgggagttatctctgaagacaaaggaaagggttacctgtttcagcatcctcgagcctgtgttcctcatcgggaggtttggatggtggccccatggatggaactcgcctaggaaactgcccttctgaatagtccaacgagtgtgtgggttgactaactgcagcccaggtataaagttgatcttgatcaaacgaagctgcattcgtctgggcattctgattacacggttccctgaagcaatcactaaaaggaaggagaagacccatggcaatgatccgggagcaaaacttctctgcttcttctggaggcccgttctcctgctggctgaacagcttctccaacagcgttcgccctgtgaacacgttctggaagccatccgcagccgcggcggccccagacgccttggggccacgtgctggggacaccccaccgncgcttgtaattcggcaacccggggttca

SEQ ID NO: 282220 - DNA, 281 bp, Homo sapiens
gatttaataaaacttctctctctctatcttgcctcttccagttatctctgaagacaaaggaaagggttacctgtttcagcatcctcgagcctgtgttcctcatcgggaggtttggatggtggccccatggatggaactcgcctaggaaactgcccttctgaatagtccaacgagtgtgtgggttgactaactgcagcccaggtataaagttgatcttgctatatttaaaaataaaaaatgttgaaatgctattaattcagttacaaaaaaataaaccatga

SEQ ID NO: 282221 - DNA, 1671 bp, Homo sapiens
agcggagtcggagacacaacaaagatggcggcggtgactgtgacggtgacgaagacggcggcggcggcgacggcatttaacaaggcggtgtggtttactccatgcagttgtcaggagacctctgtatggcttttcaattttagttgaaattctctctccatggccttttggagtcccttgctgtatctccgaagtaaatttcaattactctacatttcatcaatgttggagtggcaagaaaaaggaggaacagatttggggtgaaaagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattc

SEQ ID NO: 282222 - DNA, 1795 bp, Homo sapiens
agcggagtcggagacacaacaaagatggcggcggtgactgtgacggtgacgaagacggcggcggcggcgacggcatttaacaaggcggtgtggtttactccatgcagttgtcaggagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttct

SEQ ID NO: 282223 - DNA, 353 bp, Homo sapiens
tttttctgcctttgaaatttcttcccatcctctgtgactaagtttgaatccgtatttatatttaattattaaatatattgattttttaccattttgtgtatgtctttagttcaccagtaagattataagatgctgaaaggcaggcactgtgttttctcttgctttatatagtgtcttgcacaaaatagcttttgtcatttgtttgctatgtactagatctccctaaatagtgtaaaattgtttcagttttgttttctaggtctaacaaactgtaaatgttaaaaaagcaaagatgggtgaaaaaaaaccagagcctttggacttcgtgaaagattttcaggaatacctgactc

SEQ ID NO: 282224 - DNA, 1946 bp, Homo sapiens
agcggagtcggagacacaacaaagatggcggcggtgactgtgacggtgacgaagacggcggcggcggcgacggcatttaacaaggcggtgtggtttactccatgcagttgtcaggagacctctgtatggcttttcaattttagttgaaattctctctccatggccttttggagtcccttgctgtatctccgaagtaaatttcaattactctacatttcatcaatgttggagtggcaagaaaaaggaggaacagatttggggtgaaaagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttct

SEQ ID NO: 282225 - DNA, 1962 bp, Homo sapiens
  misc_feature (1960)..(1962): n is a, c, g, or t
atgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgcccaaaaaannn

SEQ ID NO: 282226 - DNA, 1165 bp, Homo sapiens
  misc_feature (1163)..(1165): n is a, c, g, or t
tttattgaattatttttggtgtgtctaggccaaggaaagaggagatcgtgggtggggaaacagactgagggaatcagaagcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggccttgcactccgcgtgcattggccacacatcctcgcctcctccacccgctccgccgccggttttcttggaagttaaatcttggaggatttgtccacacaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgcccaaaaaannn

SEQ ID NO: 282227 - DNA, 2077 bp, Homo sapiens
  misc_feature (2075)..(2077): n is a, c, g, or t
atgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccaccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgcccaaaaaannn

SEQ ID NO: 282228 - DNA, 534 bp, Homo sapiens
  misc_feature (296)..(296): n is a, c, g, or t
  misc_feature (391)..(391): n is a, c, g, or t
actctatgcatatggaagtttttgtgttataaataaggatataaatgccttagttaaattattattgaaatgagcatgttgaaatccagctttttaattgaaatcattagtatgttaatgtaagtgtttggacctgtctttaggggcactaagacctggaaatggccctgaaattttattgggtcagggacctcctcagcagccgccacagcagcatagagtactccagcaactacagcagggagattggagattacagcaactccatttacagcatcgtcatcctcaccaggtanccggctgctgctgctgctgctgctaaagttccagcaaaaaaagatcaccgccgcgagtaaaaatgctccagcccagaaggttcctgcccagaaanccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgtt

SEQ ID NO: 282229 - DNA, 4872 bp, Homo sapiens
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatgaagtatctctacagggtagtaacttgattcctcttcaggagaaaagggagctaaattgcaagctctaactaagggtttctgctactgacatcacaacacagaaatgcaagtgtggtacttccagtgaaagcacatggcacctttctaggtgtgtagccactgagaagggacagtgaaactgttatttttgatatcagaatgtcatttttatgtgcatatccctaaaattagggttatttctacatacactagttacacttgtgaattttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattataagaagaaaaaaagatacagaacagaaaacattcactactttagaaacactttatgcatggcttcttgccccaaacttttattgtgatggccctaataaagcagattattggaaaaattggaggacaagggttgtataaaaattttattttatgaagaaaatatgtagcggaaactgaattttcaagacatttacaatgtgaaatcatgttgcatttaacaatgtactttattagcaacttcaccaaatattccccaagtcataagcaacaattatttttattaggttttggggggtggagtagttttaataaagtgcacagaatggtgacacccacaaagccttatataaaggcaggattcatgcatcc

SEQ ID NO: 282230 - DNA, 3582 bp, Homo sapiens
actctatgcatatggaagtttttgtgttataaataaggatataaatgccttagttaaattattattgaaatgagcatgttgaaatccagctttttaattgaaatcattagtatgttaatgtaagtgtttggacctgtctttaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatgaagtatctctacagggtagtaacttgattcctcttcaggagaaaagggagctaaattgcaagctctaactaagggtttctgctactgacatcacaacacagaaatgcaagtgtggtacttccagtgaaagcacatggcacctttctaggtgtgtagccactgagaagggacagtgaaactgttatttttgatatcagaatgtcatttttatgtgcatatccctaaaattagggttatttctacatacactagttacacttgtgaattttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattataagaagaaaaaaagatacagaacagaaaacattcactactttagaaacactttatgcatggcttcttgccccaaacttttattgtgatggccctaataaagcagattattggaaaaattggaggacaagggttgtataaaaattttattttatgaagaaaatatgtagcggaaactgaattttcaagacatttacaatgtgaaatcatgttgcatttaacaatgtactttattagcaacttcaccaaatattccccaagtcataagcaacaattatttttattaggttttggggggtggagtagttttaataaagtgcacagaatggtgacacccacaaagccttatataaaggcaggattcatgcatcc

SEQ ID NO: 282231 - DNA, 3349 bp, Homo sapiens
tttaacagcaaccactatattagtgactttaagctactctttttcttaaaatacttaaaagaggatttttgattctggccaagtgagcctacctttacaactttttaaaaagatttatttcatcttgctgtagttttctagtaatagagctgcttctgtagatgattgttttttacgtttctgattttgtcaccaatgtgaaaggaaggaacatagtaaatagatgcagtgctgacagtgctttaggactggagcattgttttgtataatatcatttcttttttcagatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatgaagtatctctacagggtagtaacttgattcctcttcaggagaaaagggagctaaattgcaagctctaactaagggtttctgctactgacatcacaacacagaaatgcaagtgtggtacttccagtgaaagcacatggcacctttctaggtgtgtagccactgagaagggacagtgaaactgttatttttgatatcagaatgtcatttttatgtgcatatccctaaaattagggttatttctacatacactagttacacttgtgaattttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattataagaagaaaaaaagatacagaacagaaaacattcactactttagaaacactttatgcatggcttcttgccccaaacttttattgtgatggccctaataaagcagattattggaaaaattggaggacaagggttgtataaaaattttattttatgaagaaaatatgtagcggaaactgaattttcaagacatttacaatgtgaaatcatgttgcatttaacaatgtactttattagcaacttcaccaaatattccccaagtcataagcaacaattatttttattaggttttggggggtggagtagttttaataaagtgcacagaatggtgacacccacaaagccttatataaaggcaggattcatgcatcc

SEQ ID NO: 282232 - DNA, 3485 bp, Homo sapiens
  misc_feature (2786)..(2786): n is a, c, g, or t
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggcaagttacatatgtaacaccatttgaaaactacagaattaacaacaaaagaaaaacttacaaatgtaaagccaaaagaagaattgagtgtttaggatttctgctgagtacattgaacagcttttcaacattcagacttgtttggttatctggaatatacaggatagttttttcattgctttcatactccatatttttctctttgacatttattaaaaacagttcctattcttgctgttttctgtttgctgctttcaagttttctttttcataaatgacataattaactggggaacatagcttactgtgtctgtttacttattctgcataaatgtgttcccttatacccccaataccctgggtaatggaattattactgtctaaaattataataactcaaaatagtcattgtaagttctcaagaacatagtattcaatgacttgagatactgatctctgtgtggtagaaggcagtttcagtactagctcttttacatcctctgttaggaattgcattatccntttcaggtttgcatggacctatacaactacttctctgatgtttaatagcatctgaaagaaccctggggaaatgaatagtagagttaggagaactgaagtaagcttcagtgattggtcttttctctggacacccttatttggaggttggcctaaagattttgtacttcgcaacatgttcacaggtttgagctcgattgctgctattttgtttaactgtttactatgggtatttatattagattttaagctaattgagggtgggaaatatgaattgtctatctttgaatcctgcccagtatacaacccagtaggtacctaatactgttcattgaatgtgcagaaaaaaatcatgactatctataaaaattcatattccttagatttaggacagtggccttaaaaaaaatgcccattaatgggccgggcgcggtggcttgcgcctgtaatcccagcactttgggaggccaaggcaggcggatcatgaggtcaggagatcaagaccatcctggctaacacggtgaaaccccatctctactaaaaatacaaaaaatcagccaggcgtggtggtgggtgcctgtaatcccagctactcgggaggctaaggcaggagaatggcgtgaacccgggaggcggagtttgcagtgagccgagatcgtgccagtgcactccaacctgggcgatagagtgagactctgtctc

SEQ ID NO: 282233 - DNA, 2695 bp, Homo sapiens
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataagtgttgtaaacaattactgagacacggagcactgttaactgaaattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcactttaaatcagatat

SEQ ID NO: 282234 - DNA, 3840 bp, Homo sapiens
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatg

SEQ ID NO: 282235 - DNA, 3172 bp, Homo sapiens
attaaggatcacttaaaaattaatacaggtattttggataatagtaataattattttgaatagaattatcttgaaggacctttttactatggccttggaactttcttgaataattccccagtgttcactaaactcactttttcttttgtgtcactttttcaatagaataatcaagtttgtcattcatacttctagtgtagagctgttctgtgattgatctacccttagcttgggataatgctttatttataaaatagcaatttctgcattttctgtaggcattaataaagtttgctagaatcatcactgatcttagagtggaacagaaaatacatattttttatccttataatgtgcccctaagtagtataatgtgtgtttcataaaacttcttaacattttgatctattcttgcagggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatg

SEQ ID NO: 282236 - DNA, 4200 bp, Homo sapiens
  misc_feature (3501)..(3501): n is a, c, g, or t
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggcaagttacacatgtaacatcatcactgtcacaaataaaacacacaagaacaacagcaaaatcttataaagtggaagtaagactctgatgttagttagctacagaaagtagaaaatattttaacctttagccatcctactcttcttaatgatgttctttgcattgagttattattcagttgtatctttgccaacatagaaaaatgctgatttacacaatagaaacataactgcttcttttcatctttattattggatactgttgaaaaaaatatttaaagatatttttatacttggcttttgcttaaaaatttgatattttcctagtttgtacatgctctcttgtagatgcattttaaaagtattaatagttttgtatttgtcacaatcactttgttttactcttgtcttcttatatccctcttttgatttcaattcagaattcaaatattgatgtttttcactgttaaaaattttcagtaataatttcaaattacccagttaacacttggaagatactaggatggaataggatcgtgcattggcataaatgaattttcatgtatgtatggttatagtggaaaaaaagagttttaatcttggcaaagggaaatatgttagaagaagttatgctttattagaaggtaaaagttcgatatattcatggtaactgtcggccatgttcttcagttctgttccttttgtttctcactcaggcaagttacatatgtaacaccatttgaaaactacagaattaacaacaaaagaaaaacttacaaatgtaaagccaaaagaagaattgagtgtttaggatttctgctgagtacattgaacagcttttcaacattcagacttgtttggttatctggaatatacaggatagttttttcattgctttcatactccatatttttctctttgacatttattaaaaacagttcctattcttgctgttttctgtttgctgctttcaagttttctttttcataaatgacataattaactggggaacatagcttactgtgtctgtttacttattctgcataaatgtgttcccttatacccccaataccctgggtaatggaattattactgtctaaaattataataactcaaaatagtcattgtaagttctcaagaacatagtattcaatgacttgagatactgatctctgtgtggtagaaggcagtttcagtactagctcttttacatcctctgttaggaattgcattatccntttcaggtttgcatggacctatacaactacttctctgatgtttaatagcatctgaaagaaccctggggaaatgaatagtagagttaggagaactgaagtaagcttcagtgattggtcttttctctggacacccttatttggaggttggcctaaagattttgtacttcgcaacatgttcacaggtttgagctcgattgctgctattttgtttaactgtttactatgggtatttatattagattttaagctaattgagggtgggaaatatgaattgtctatctttgaatcctgcccagtatacaacccagtaggtacctaatactgttcattgaatgtgcagaaaaaaatcatgactatctataaaaattcatattccttagatttaggacagtggccttaaaaaaaatgcccattaatgggccgggcgcggtggcttgcgcctgtaatcccagcactttgggaggccaaggcaggcggatcatgaggtcaggagatcaagaccatcctggctaacacggtgaaaccccatctctactaaaaatacaaaaaatcagccaggcgtggtggtgggtgcctgtaatcccagctactcgggaggctaaggcaggagaatggcgtgaacccgggaggcggagtttgcagtgagccgagatcgtgccagtgcactccaacctgggcgatagagtgagactctgtctc

SEQ ID NO: 282237 - DNA, 272 bp, Homo sapiens
ccgctattttgcgtagggtgctttcgccgcgattctgagaacctttgaagtcagtactggagaaggattcgctgagattcttctagtccaacacgatcgttgtacagaggttcatttcctgttgagcagttagagcatgtgcattatttcctcacatgacatcaacagtgcagcatcagcctctggcatgtaaaggcacccagtagacttatgctctgtgcaatggctgcttagcaaccaccatcaaataaagtaatgaagcttttgtagag

SEQ ID NO: 282238 - DNA, 699 bp, Homo sapiens
agcggccgccgcgactcttgcctcccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagcta

SEQ ID NO: 282239 - DNA, 486 bp, Homo sapiens
gcggccgccgcgactcttgcctcccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaaggggggcagcgacggggcaggtggcgaccccgtgcgggccgcgccggactcacctgtctccccgggaggcagtgcgccctgcgcccgcagcgaggggaactctactcctccgccgaagcaacagccggagacacctccaaaaccctgcaaactttggtggaacgctggcaacatgaatttaagctagacagcacagcggcacggtgcgcgtaagggacttgcacctcc

SEQ ID NO: 282240 - DNA, 580 bp, Homo sapiens
ctcgcgaacgtgttatcctcttcaacatgaagaggataagaagtcagcaatgtctcaacttttgcagttgaaagatcgagagaaaaatgcagcaagagattcatggcagaagaaagtagaagatctcttaaaccaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagcta

SEQ ID NO: 282241 - DNA, 2369 bp, Homo sapiens
gagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagcgagcccgcagccctccggccatccctggcttgctggcacgcctctccagccttggcctcttgcattggcctgtgtgggttggggccaaaatctcccacgggagtttttcggtccccggccatgtggctggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggtcagcggacctcagggcggaggcttcccacggggaggcaggaagaaataaaggtctttggctttctccagaaaaaaaaaaaacaaagaaaaacaaaagcaaaaccaacacaacgaaaaaaagaaggagagaaggacgacaaagagagaccaacacaagaaaagaaccagaagagaggggggcccacaaaaaggaacaccgccgggaagaggcccaaaaagagaggcaccacactgtgttataggagcacagcagcggcgccgcaccccaaaaaaagaagacggagacatatgcaacacgacggagcgcgacacgcggaaacaacacagaacgggagacacgacgaagcaacacaaacgccgaggcgcgacagacctcagctagaagaagagcaaccccacacaactacctgaagggggggaaacaagcaaagcgctggccgacaacctcaacaagcgggagaa

SEQ ID NO: 282242 - DNA, 670 bp, Homo sapiens
gtgagccaccgtgcccagcccaggaattgctttttaaccgcctgctgctgggtactgccacttggatgcccaggtccacattaataattacaaaatggtggttaacacagcatcttcatcacctaagctctgtcccatgtacgagccttccctcatcctcccttttctgcctcccaaccagaatgatctctgcctttcacaaagaccacctttgtgcatccatgcctactcttcagaacaccactgcaagaaatcccctcagccactttgtcatccaccaaggctgaaaggtaaccctctatgaagctctgctgaccacctcctttgggtcctgctaacctaccctctgtttcatgacacttaggacactgggagctagaggtcattggtatgactgtctctcccatggactaagctgtcagagaacagagactgtctcattcctggctaccagcacctgccagacagcaggaactcaataaaaatgggctggactgatctgctggcttgactggtcagtgtttacctgagcaagaagaagctgtcatttgattcaccccagcgcctcactgcctctcaagcactaaccttgttcttacgtccatcaatctcaaagaaggagatggtgccttgcggtaaatctcattgcctggaggatgtcgtaggtcac

SEQ ID NO: 282243 - DNA, 1810 bp, Homo sapiens
aaatgtcaggctggtacggcccgagtttatggattcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctcgctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccccctcttgctccagtccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaac

SEQ ID NO: 282244 - DNA, 797 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacgggctcccggcgggagcccgctgtcctgctagtcttgtacatgcatataaagaacctgcctgcccaggctgcggacacatgtccagacggtgagggtggtgggcctggagggctctgacaagctcaccattatccgaggctgc

SEQ ID NO: 282245 - DNA, 2036 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcggtgagtagacgaggagttccgtcttgcccccgggtggatgggctggggagcacaattgcgcagacggagcctggaggattctactgggtagtgtgtgggaagcgtagctccctgaccactcttcctagcatgtctagaagcggttattctgaacagctgggtccttcctcgggtatgggggccagcttgccgccctgtcttacaagtccaacagtagaggcgactcctgttgcagattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctcgctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccccctcttgctccagtccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaac

SEQ ID NO: 282246 - DNA, 2042 bp, Homo sapiens
caagcaggctggtacggcctgggggttaaggtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcggtgagtagacgaggagttccgtcttgcccccgggtggatgggctggggagcacaattgcgcagacggagcctggaggattctactgggtagtgtgtgggaagcgtagctccctgaccactcttcctagcatgtctagaagcggttattctgaacagctgggtccttcctcgggtatgggggccagcttgccgccctgtcttacaagtccaacagtagaggcgactcctgttgcagattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctcgctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccccctcttgctccagtccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaac

SEQ ID NO: 282247 - DNA, 656 bp, Homo sapiens
ggacgcgtgggcgacccacgcgtccggtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcac

SEQ ID NO: 282248 - DNA, 654 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcac

SEQ ID NO: 282249 - DNA, 663 bp, Homo sapiens
aaatgtcaggctggtacggcccgagtttatggattcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcac

SEQ ID NO: 282250 - DNA, 823 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggtgagccctgcggccggactacggctcccggcagcccccgcgccggcctgcgcgcttctcatcgcctgggctcctggggatcgtggtccgtccggaggtggcgggagggcagctccgggctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcac

SEQ ID NO: 282251 - DNA, 1801 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctcgctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccccctcttgctccagtccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaac

SEQ ID NO: 282252 - DNA, 1277 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcactccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaac

SEQ ID NO: 282253 - DNA, 1059 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggtgagccctgcggccggactacggctcccggcagcccccgcgccggcctgcgcgcttctcatcgcctgggctcctggggatcgtggtccgtccggaggtggcgggagggcagctccgggctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacgtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaac

SEQ ID NO: 282254 - DNA, 1185 bp, Homo sapiens
ggcgctttccgcgccagcttcagtgtcctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggtgagccctgcggccggactacggctcccggcagcccccgcgccggcctgcgcgcttctcatcgcctgggctcctggggatcgtggtccgtccggaggtggcgggagggcagctccgggctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgaatgatctctgcctttcacaaagaccacctttgtgcatccatgcctactcttcagaacaccactgcaagaaatcccctcagccactttgtcatccaccaaggctgaaaggtaaccctctatgaagctctgctgaccacctcctttgggtcctgctaacctaccctctgtttcatgacacttaggacactgggagctagaggtcattggtatgactgtctctcccatggactaagctgtcagagaacagagactgtctcattcctggctaccagcacctgccagacagcaggaactcaataaaaatgggctggactgatctgctggcttgactggtcagtgtttacctgagcaagaagaagctgtcatttgattcaccccagcgcctcactgcctctcaagcactaaccttgttcttacgtccatcaatctcaaagaaggagatggtgccttgcggtaaatctcattgcctggaggatgtcgtaggtcac

SEQ ID NO: 282255 - DNA, 4280 bp, Homo sapiens
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgccccgcggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccgggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactt

SEQ ID NO: 282256 - DNA, 1801 bp, Homo sapiens
cttagacatttaatccccacagtaactaatctgcccatgctattgttctctttattttacaaacgaggaaactgaggcccagaggggtcatttgcccaaattacacagcaaatgagtggcagcactggatttttttaaaattaaaaaattggctgggcacagtggctcatgcctgtaatcccagcactttgggaggctgaggcgggtgaatcaccggaggtcgggagttcaggaccagcctgaccaatgtggagaaaccccatctctactaaaaacacaaaattagccaggcatggtggcgcacgcctgcaatcccagctacttggggagggctgaggcagggcaaatcgcttgaacctgggaagcagaggttgcggtgagcccaagatcgcgccattgtactccagcccgggcaacaacagccaaactccgtctcaaaaaaaaaaaaaaaatttaaaaattgtcttttgttattacaaagtaggataagtagaccaatataaacaaaaaataataaaataccgtatcccttctacccaaaagttaccattgtgagggcttatcctatctttctaggcatatatgcacaaacacacattttggagatttttttaaaaacaaatctaggtatttatttaacacttaaaagagtacttactctgtgccaggaactattctaagcactttgcatatattaattcatttaattctcacatcagctctctttgctctccaagtcaatacattttcatctagagctgggattctaagccagacttcattaaccacccacatacccccttaaaaccacaatgctagattacctctcaatgagtgtaggaaatggatgtgatgaaagacagaaaaaagcatgaggcctaaatgtgtgaatggcttgaggaatgaatgctctgactgaagaaagaatgcctgagatccgcacactccttccactggcctgtagaggcagcagccgttgcccaaatgaggcagacgaacctagctttgaatctcagctctagctgattcactgggtggcactggacaaatcactcctgccacctgagcttgagcgtcttcatctgagataggaatagcagtccctacactgaggaggtattaaagctaggaggagccaggctaggccttctgtcaacattgatgcccggtgtctctggccacagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggtatgcatcctactccttcgggtcctttcagccacctggcaaagccagatccagtccttgacctctccttggccttggaagataaggtgagccttggaagataaggtgagcctatctctaagaggaaatcagaaccccaacccttgagagacaaagactggctagagacaaggagtggttgtggtatgtagggaaaaccaggatgagttgtgggcctggcttcctggaaggagtagagatggggaactgctaggtccaatttggagtgggtaagagtatgcagatgggaccgagcgcagtggctcacgcctgtaatcccagcactctgagaggccgaggcaggtggctcacctgagatcaggagttcaagaccagcctggccaacatggtgaaaccccgtctctactaaaaatacaaaaattagcctggcgtggtgacgtgtgcctgtagtcccagctactcaggaagctgag

SEQ ID NO: 282257 - DNA, 1213 bp, Homo sapiens
  misc_feature (35)..(35): n is a, c, g, or t
  misc_feature (188)..(188): n is a, c, g, or t
cggagcccgcggagcagaaagtagctctcgcagcngcaggcggaggacgggtcgacggctaacggacgaagaatggggcccggaccagctatagcactcggcctgacgaaggtcagcaggttgcacaacagctggcttagccgtcagaatcaaacgatgtccattccggacggggtctgtacagcggngttcttaccccacccacatacccccttaaaaccacaatgctagattacctctcaatgagtgtaggaaatggatgtgatgaaagacagaaaaaagcatgaggcctaaatgtgtgaatggcttgaggaatgaatgctctgactgaagaaagaatgcctgagatccgcacactccttccactggcctgtagaggcagcagccgttgcccaaatgaggcagacgaacctagctttgaatctcagctctagctgattcactgggtggcactggacaaatcactcctgccacctgagcttgagcgtcttcatctgagataggaatagcagtccctacactgaggaggtattaaagctaggaggagccaggctaggccttctgtcaacattgatgcccggtgtctctggccacagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggtatgcatcctactccttcgggtcctttcagccacctggcaaagccagatccagtccttgacctctccttggccttggaagataaggtgagccttggaagataaggtgagcctatctctaagaggaaatcagaaccccaacccttgagagacaaagactggctagagacaaggagtggttgtggtatgtagggaaaaccaggatgagttgtgggcctggcttcctggaaggagtagagatggggaactgctaggtccaatttggagtgggtaagagtatgcagatgggaccgagcgcagtggctcacgcctgtaatcccagcactctgagaggccgaggcaggtggctcacctgagatcaggagttcaagaccagcctggccaacatggtgaaaccccgtctctactaaaaatacaaaaattagcctggcgtggtgacgtgtgcctgtagtcccagctactcaggaagctgag

SEQ ID NO: 282258 - DNA, 2497 bp, Homo sapiens
tagcctcgtgtaatcccgaggccatgcccttttggagagaaggagcctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactt

SEQ ID NO: 282259 - DNA, 2292 bp, Homo sapiens
cttagacatttaatccccacagtaactaatctgcccatgctattgttctctttattttacaaacgaggaaactgaggcccagaggggtcatttgcccaaattacacagcaaatgagtggcagcactggatttttttaaaattaaaaaattggctgggcacagtggctcatgcctgtaatcccagcactttgggaggctgaggcgggtgaatcaccggaggtcgggagttcaggaccagcctgaccaatgtggagaaaccccatctctactaaaaacacaaaattagccaggcatggtggcgcacgcctgcaatcccagctacttggggagggctgaggcagggcaaatcgcttgaacctgggaagcagaggttgcggtgagcccaagatcgcgccattgtactccagcccgggcaacaacagccaaactccgtctcaaaaaaaaaaaaaaaatttaaaaattgtcttttgttattacaaagtaggataagtagaccaatataaacaaaaaataataaaataccgtatcccttctacccaaaagttaccattgtgagggcttatcctatctttctaggcatatatgcacaaacacacattttggagatttttttaaaaacaaatctaggtatttatttaacacttaaaagagtacttactctgtgccaggaactattctaagcactttgcatatattaattcatttaattctcacatcagctctctttgctctccaagtcaatacattttcatctagagctgggattctaagccagacttcattaaccacccacatacccccttaaaaccacaatgctagattacctctcaatgagtgtaggaaatggatgtgatgaaagacagaaaaaagcatgaggcctaaatgtgtgaatggcttgaggaatgaatgctctgactgaagaaagaatgcctgagatccgcacactccttccactggcctgtagaggcagcagccgttgcccaaatgaggcagacgaacctagctttgaatctcagctctagctgattcactgggtggcactggacaaatcactcctgccacctgagcttgagcgtcttcatctgagataggaatagcagtccctacactgaggaggtattaaagctaggaggagccaggctaggccttctgtcaacattgatgcccggtgtctctggccacagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactt

SEQ ID NO: 282260 - DNA, 4071 bp, Homo sapiens
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgccccgcggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccgggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactt

SEQ ID NO: 282261 - DNA, 4114 bp, Homo sapiens
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgccccgcggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccgggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactt

SEQ ID NO: 282262 - DNA, 3789 bp, Homo sapiens
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgccccgcggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccgggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggtatgcatcctactccttcgggtcctttcagccacctggcaaagccagatccagtccttgacctctccttggccttggaagataaggtgagccttggaagataaggtgagcctatctctaagaggaaatcagaaccccaacccttgagagacaaagactggctagagacaaggagtggttgtggtatgtagggaaaaccaggatgagttgtgggcctggcttcctggaaggagtagagatggggaactgctaggtccaatttggagtgggtaagagtatgcagatgggaccgagcgcagtggctcacgcctgtaatcccagcactctgagaggccgaggcaggtggctcacctgagatcaggagttcaagaccagcctggccaacatggtgaaaccccgtctctactaaaaatacaaaaattagcctggcgtggtgacgtgtgcctgtagtcccagctactcaggaagctgag

SEQ ID NO: 282263 - DNA, 1987 bp, Homo sapiens
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgccccgcggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccgggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactt

SEQ ID NO: 282264 - DNA, 298 bp, Homo sapiens
gtaagtggtcaagctggaaggagcagacttggggaggagaggtctgcagggatgtggtggggcatctgcagccagatctgagcccctctgcttctgcctgtcacagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaagtgagtgtgtgcacccaggccccttcctacttctccacactaatagctctagg

SEQ ID NO: 282265 - DNA, 314 bp, Homo sapiens
gtctgacgactcagacctgacttgctcaggagagccagcccgatccggtccactttcttgaggtctgacgtccaatccacctcactgggttccaacagatctccacttttggaggaaggatcttcacttgatctaagcctattccttggacagggctgggctggcttgaataactgtggtgctcatctcattggtggtatcactctgagtgtgacaaaattttaaaaataatcagataaactgaatacaacaaattcaagtcatgctgatataaactcgggtaatgtaataaaggaatctacacgggttatctt

SEQ ID NO: 282266 - DNA, 581 bp, Homo sapiens
gcaggacagagttttacttccttggtctgatgtaattttactttcacccctgtcttactttgagacaccaaacagtctggatgtttcaccagtcctgtacttttgaaagttagatatgttggaatcccttccgtattctagaaagaaactctagtttcttcaagatcttaggtcaattttctgaatttctattttggtgaagaaagtattctcattttctcctatcgtccagtgtcaaaggtgccttgttgacccatttagcccctgccagtccttgcactgttggaaataagccatttatcttcttccttccctgctgctgaacatatcttgcctgtgtctctctgtggccagaactccgcactttatacctcaaagagagaaggaagagaaaggggtgggagagtggaaaggcaggagcaacaaggacatgacctccccagttaagccccccagctatgcctgtgatacccgctgagcaggccagctggagcctgtgtgtgcttgggtagcagaaaggcagtcctattctgtggatctcaaggatggcatgcggtgtcctttttccagggaattgtact

SEQ ID NO: 282267 - DNA, 675 bp, Homo sapiens
aggtagcaaggcagccccctctgataaccacgatgaggctcctctcccttccctttctgcccccattgtcggagtatctgctggagtgaggtacggatggaggagctggctgactgcagtgagggaaaagctccctgtggccacaaaccctccccaagcacacactccaggctgcacacgactctgcctcttgttagctgggcagccttgggcaagggggagaactgactccagcctcagtttctttctctctacatggggatcctcctccttccttaggttgccaagaggatgaaagtcacaagtgggcgtggcagggctttgttccttctgaagctcaggacaaagcactgggcttccctcctgcctgggagccttcaggacggcatggagtttggccacgtggtgggagcgccctgagtgcgtggcacagaatgttcaactggttacctctcctgagcctcacagcctctcaaggaagatctgaggaggaaactgaggcccacccccacccagactgaggggcaggactcactgcaagtggcctcggactcatcggagccatcaggacactcctcctcgccgtcacacttccaccgttcgtggatgcagtggccgttgtcacaggtgaagtcactgtctgcacaggtcttcttggctgcagggcaaggaaga

SEQ ID NO: 282268 - DNA, 2498 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282269 - DNA, 409 bp, Homo sapiens
gcttctcttccttcctgttggttgtggattggaaagtttctggggtacctgtccagccatttttcttcctcttgttcagacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282270 - DNA, 574 bp, Homo sapiens
ctgctttgtatatcacactctgaatataattcttgtcactgtggatttgggctccctttctatgtccaattcctcttcccttatttaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggcaagtgacagtacaggttgcatggctaaccccaaccttttgtacacccagcctagatttcccttagcctagtgca

SEQ ID NO: 282271 - DNA, 215 bp, Homo sapiens
taccgactcgagcttggtaccctcgataagggcaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282272 - DNA, 204 bp, Homo sapiens
ctgttctctccaacctaagcctccattctcattggtatatccagaggattttctaagccttggactgcagcccagctacatctgcattgagagaaacctgcgctagcttctcctcagctaaggttgagaaagatcttttcttttatggcagaagaagaccctcgggaagcagtcagactgccataaaaaaaaagttggcggccg

SEQ ID NO: 282273 - DNA, 2509 bp, Homo sapiens
agttattgcagtggaggctgggttgaatcggccgagggaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282274 - DNA, 3318 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcagtgagtaaaggtccccatcctgagtcattttgggtatagagaggataatttggaggttaaagttggcattggctacttggcaatattcccttggtctggttgggtgatgttgggaaaggcaggaggcaagttaaacccatttttggagtttttgcacctagggactctcgggcccggccaccttatactgttgcggctgacaaatcaacacgtaatgagttccgaaggttcatggagaagaatccagatgcctacgattacaacaaggctcaggtcatctggaataggaaggacaagcagagtgggaaggcatcacagatcctggctagatcctttctacttcttgcagttttaccaaagataacttatagggtcttatatttgaaatcctccaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282275 - DNA, 3196 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcagtgagtaaaggtccccatcctgagtcattttgggtatagagaggataatttggaggttaaagttggcattggctacttggcaatattcccttggtctggttgggtgatgttgggaaaggcaggaggcaagttaaacccatttttggagtttttgcacctagggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282276 - DNA, 2923 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcagtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282277 - DNA, 3602 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaatgtgtacttgtacttacattcagaggcactgtggcctttagttccttagggtcaccgtggccagcaccaagggatcctgcccactccatgtcccaggtccaagggttactttttttttttttttttttttttgagatggagtgtctcactgtcagccaggctggaagcgagactctgtctcaaaaaacacaaacaaacaaacaaaagaaatgtaaaatctcagatcctacctcagacctatagaatcagaatttgtattttaacaagattcccaggtgatcctaggcaccttcaaaattgagaagcatggctttacttgactgggctccctgaggacagggagtgccctgttcatctcaaatcctcagcctctagcacagggccgggtatatagtaggttaaatctggatgaatcaatgtcataaccaaaaggctaaaacaggttcagaaccaggggaaaccattggaaaatcttcagggtgatccggggtgtggaagggaggaaccaggtcacaagaaggacctctttcctggagagtcctgtttcagcaaaacagccattccctc

SEQ ID NO: 282278 - DNA, 2991 bp, Homo sapiens
agttattgcagtggaggctgggttgaatcggccgagggaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282279 - DNA, 2878 bp, Homo sapiens
agttattgcagtggaggctgggttgaatcggccgagggaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctgagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282280 - DNA, 1135 bp, Homo sapiens
gcggcccctactactactaaattagcggccggcgatctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282281 - DNA, 1054 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaagggtgagagggtgctgcatgggggtaaggatggagtggatcctgttagccagggagcaccagctggtctccagtactgagtctgtgctgtctacagaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggtgagttaagccttttagatctggtggtac

SEQ ID NO: 282282 - DNA, 253 bp, Homo sapiens
ctggcatcggtttaacctaaagcaacgtctcaaggacaagcctctcctgtctgccctggactttgaaaagcagagctccacaggtgatgagtggtagggggacctatgtaggagtaggacatggaggtataagaaagcactagtttagagtttgaggaaagaacaaaaatggggtaccaaacttgtgtatctcatattgtctgtcttcaggagatctttccagcatctcgggatcagaagactcagactcagc

SEQ ID NO: 282283 - DNA, 682 bp, Homo sapiens
tgggtatcacgcttgacaacatagtcttgaattgaaactggcctgaattgtggaagggttaagtgtaatggaattaagtttggaaacaaaccaatttaggtttgaattgtgattctaccacttcatcttgactgcctcgccaagcctcaaatttccttgtttgtcaaatggaaacaagcctcagggtggtaatattaaatgagataatgtttgtgaaaattggcccttagtttcttgctctcagtgaatgcaacagatatgtttctgatgcttctctgtcatcaaggatcccccagaagaggcagaactgctgctacagaacctgcaaagtagaggtcccagagactgcgtggtgctcatggctgcagctgggcactttgctggtgctatatttcaagggtgagagggtgctgcatgggggtaaggatggagtggatcctgttagccagggagcaccagctggtctccagtactgagtctgtgctgtctacagaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggtgagttaagccttttagatctggtggtactgatccatact

SEQ ID NO: 282284 - DNA, 387 bp, Homo sapiens
tggtactgtctctggaattttaatcacaataaagtttggcaaggaatgtgtacttgtacttacattcagaggcactgtggcctttagttccttagggtcaccgtggccagcaccaagggatcctgcccactccatgtcccaggtccaagggttactttttttttttttttttttttttgagatggagtgtctcactgtcagccaggctggagtgcagtggtacaacctccactcactgcaacctctgcctcctggattcaagcaattctcctgccctcagcctcccaagtagctgggattagaggtgcccaccatcacgcccggctaatttttgtatttttgtggagacggggtttcaccatgttggccaggctggtcttgaagtcc

SEQ ID NO: 282285 - DNA, 2488 bp, Homo sapiens
cccgggacgtttggtgcgtcttctaagggcgtgggcgagtttacgcgggccagttgttgctggtcgcatgggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282286 - DNA, 3035 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282287 - DNA, 3425 bp, Homo sapiens
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaatgtgtacttgtacttacattcagaggcactgtggcctttagttccttagggtcaccgtggccagcaccaagggatcctgcccactccatgtcccaggtccaagggttactttttttttttttttttttttttgagatggagtgtctcactgtcagccaggctggagtgcagtggtacaacctccactcactgcaacctctgcctcctggattcaagcaattctcctgccctcagcctcccaagtagctgggattagaggtgcccaccatcacgcccggctaatttttgtatttttttgagatggagtgtctcactgtcagccaggctggagtgcagtggcacaatctcggctcactgcaacctctgcctccgagattcaagcgattctcc

SEQ ID NO: 282288 - DNA, 3500 bp, Homo sapiens
  misc_feature (3044)..(3044): n is a, c, g, or t
gtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaaaaaaaaaanaaaaaaaaaaaaaaaaacacaaacaaaaaaaaagacaaagccacaacacagaaaacaccacaacgaagcaacagcacgaaagaacaagacacaacacaaaaaacaaaaaacaaaaaaaagaggggggggcgcccgaaaacaccacaccaccacagggacgcacagagacaagcaacacaacacacacagaaacacaacaaacaggcagaggacaccaacaaaggagagccacacaaaaaacaaagacaaaaggggcgaggccacacacaaaccagaagaaacagagagacaggcacgccacaacccagggaagacctcaggagcagcgcaacaccaacacaacaaaacgaagggcgggagacacaaacaagcgcaaccaacaccgaccgacgaagacagccgcccaaggggagacgaaggaaaaacaaaagagggcgcgaggagcaaacaacgagt

SEQ ID NO: 282289 - DNA, 2027 bp, Homo sapiens
ctgttctctccaacctaagcctccattctcattggtatatccagaggattttctaagccttggactgcagcccagctacatctgcattgagagaaacctgcgctagcttctcctcagctaaggttgagaaagatcttttcttttatggcagaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggtttgattactatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282290 - DNA, 701 bp, Homo sapiens
ccccccgaaattgggatcaacacgcccaaaactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaa

SEQ ID NO: 282291 - DNA, 897 bp, Homo sapiens
agttattgcagtggaggctgggttgaatcggccgagggaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctgagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaagggtgagagggtgctgcatgggggtaaggatggagtggatcctgttagccagggagcaccagctggtctccagtactgagtctgtgctgtctacagaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggtgagttaagccttttagatctggtggtac

SEQ ID NO: 282292 - DNA, 2374 bp, Homo sapiens
cacctggcgcacctgtccttttttcttctatttttcagaaccctgggcggaaagcgcgagcgagttgggcagatgccggcggccgcggtgcaggaagcggtcggcgtgtgctcctacgggatgcagctcagctgggacatcaacgatccgcagatgcctcaggagctggccctctttgaccaattccgagagtggcctgacggctatgtgcgcttcatctacagcagcgatgagaagaaggcacagcgtcacctgagcggctgggccatgcgcaacaccaacaaccacaatggccacatcctcaagaagtcgtgcctgggtgtggtggtgtgtacacaggcctgcaccctgcccgacggttcccgcctgcagctgaggccggccatctgcgacaaggcacggctgaaacagcagaagaaggcatgccctaactgtcattctgctttggagttgattccttgtcgagggcacagcggataccccgtaaccaacttttggcggcttgatggcaacgcgatcttttttcaggccaagggagttcatgatcatccaagaccagagagcaaatcagagacagaagctagaagaagcgccatcaagagacaaatggcctctttctaccaaccccagaaaaagagaattcgagaatccgaggcagaagaaaatcaagacagcagtggtcatttcagcaacatacctcccttggaaaatccagaagactttgatatagttactgaaaccagcttccctattccagggcagccttgcccttccttcccaaagtctgatgtttacaaagctacctgtgacctagccacctttcaaggagacaaaatgccacccttccagaaatactcaagcccaagaatctatttgcctaggccaccttgcagctatgaattggcaaaccctggttatacaaattcaagcccatatcccaccctttataaggattccaccagtatccctaatgacacagactgggttcatctgaacacactacaatgtaatgtcaattcatacagcagctatgagagaagctttgatttcaccaacaaacagcatggctggaaaccagctcttggaaaacccagccttgtggaaaggactaaccatgggcagtttcaggccatggccactcgcccttattataacccagagcttccctgcaggtacctcacgactccaccaccaggtgcccctgccctacaaaccgtgatcaccaccaccactaaagtgtcctaccaggcctaccagccccctgctatgaaatacagtgacagtgtgcgagaggtgaagagcctttcgagctgtaactatgctcctgaagatactgggatgtctgtctatccagaaccctggggtcctccggtgacagtcaccagggcagcctctccttcagggccacctcctatgaaaattgcaggagattgccgggccatcagacccactgtggctattccccacgagccagtttcctctaggacagatgaagcagagacttgggatgtgtgtctgtctgggctgggctccgcagtcagttactcagacagagtgggtcccttctttacctacaacaatgaggatttttgaaagacaatccaggggacataatagcagtgtgcatgcaggcaggaggcagggaaatgtgaaatggcaatgatctcttattgagttgggagattcaccttgtgtgcaaagaaacacagatagtagtaaaaattctgagtaactgagaaaataatcagttggaaatgattagataatatgggaaatttcacacagcattttgaaactggctacaatacatagaagtagtgaggaaagtgtgagtctctcaaatgaacaaataagcaaactgtaggaggttaaatactgacctaagttcacttagcttattagcaggagtagaagtcaaggattctggttcttattctaggacttttcccattagagcaccttagggaatttcacatccctagaggctgccaaaatagcttcaggaagaaatttttacaatcttatcacctgagtcatttcatgaaatttttgtttagcatttagaacctgttaaactagcttcaggaagtaattttgattgttttatctccaacgtgtgtatctacagcttttcaaaaaatctctagcaatggtaaagttcagttgtttttaaaagattcaatattagcttttcataacatgatagtttcctaaccttttcataaccttttcataacatgatagtttccataacagagacagcctaacaatgatgagttgtatttaatggattaccattgtactaaatacattttttttctgattaggtttcagaattataattaaaatgttttgctgaaatacaaaaaaacgg

SEQ ID NO: 282293 - DNA, 2588 bp, Homo sapiens
gaccggtggcccccacacagggtttcccaaagcctctccatttgtctgcactctccactgccgaccttgtaggaaatttatttccatgcccagaaatattgtttggacacagtggctcggttatcttcgcgcctgcttttcttaaatacatttatttcacctctgccacgctgcagatatttaaagatctgtagataccgtaaccctcagcgatgcgggactcactctggttatagataatattctctgggtggttatttgaacataagttctatctccagcccagatgacacccaagcaggggctgtaaaggacacttgctctagaatgttttcaactgaaatatatgtccacacacggagaatttaagagtatttttatatttctctctagatctaaatattcagatgtgttaattacatgccctagaagctggaagcattcagtggtgttcacactggacgtggagctgtttgtataattttcatctccctgcacttaaacatgactctcagtctaataaattcaaccttgtcatttttagaatcgacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctggacaagcggcgcccccaggtcgagcggcctctcgctgcctggcagtgcctggcagcccccacctctgccagtgcttcggaaacccgcctggccaggttcgcccgcggtgaaaaatgaaagcaaattccccaacagaggtagccggaactttcctcgacgaaggctccctcctgcgcctgtgtctggagaacccccagagcgctgcaagttagcaagagagattcgatggcggctctggaaggcgcacgaagggtggggcgggggagcaaagaggccactgggtgacccagcctggtccggggtgaaacgctagagaaggcgcctcgccttccttatttcaatgcaactcctcggccccagacggtaaaaatagtttccaagctgccgcggacgcccaggatgtgtttgcagagatcaaactggggaggaggcagctttgtaaaagttgcagaaagattagccgagaagcgtccgcccggcggggctcaagaaagcttggggacagctccatgttccttggggcggaatggcccaagaattggcctgggtaaccccctgcccagttctctgtcctcacttcgagccagtgcttaaataacttcccgccgcctgccctgcaaacttcccggcgcggcgccgttgaggccaggacacagcaaaggctagcaaaaccccgccgcggcgcgctcggccccggccctgagaggctgcgcgggtgggaggaccagtgtggtttctgctcccactcggctgcccagaccctcaagaccgatcccccaactcctgggagcgggtgcttccctctgggagccgagatcttgcggggccagcgagggcgcaaagtgcgcgcgctggcccgcgcgggggcggccgcgcgtctctccgcggggcctgtcgccaggccggccgcggcgcgtgagtgatgagggcagagaagggcgcccataaatcgcgggtgtcagggcgaaaaactctctttattgtctgcgtgatggatgggcccggggacgagacaccaaatacttcgtatcgcctttaaatgggaacacattttccgcggccataattcatgttttttaaatagaaagtttgaaatgttgcctatatttcaccagccctgacatatttatgaatcgctccctgcatgcaaatatcattacttaaagcgccggggagagcgcgggggaggggaggaggcgcggttcccggggcgtgggggtggtgaaccggggaaatatcggtggaggggggccatctccctaaagggcagagggtgaggtgcggtgaatagccgtatccggaaaccgagcgtgccccgggcttctttcccgccgccagaccccgcacagccgccctgggacgtttttcgaggcttgggacctaagacgggtccccggaccctgctgggaaaccagggggcgtttttcgtccctctctgaggccattatccaagctgaaaccaccttttataagaaaaaagtttaaagaaaaaaaatttaacaaacacaaataataataataacccaacatgtttcgcgttctttgccactgcatcgattttattgattttcattctgcaaacctgggaatgtgcgcgctcgggaggggaggctgtcaaaacccagtcatcgcggggactggatgggggacaattctccgacgccgcggcctggacccgcccccacccaaccggcgcaccacctcccaggcaccacggagcctgcgcaagctgcggggccgtaaaggaaccggcccccaatctccggggcttcagtcccgcccctctctccccccagtgccctgcagcgctcccagggtccgtgtctgccctccccaagcccccactgtcaatacaatccctgtt

SEQ ID NO: 282294 - DNA, 2499 bp, Homo sapiens
tgtgcgcctgccctctcggtgtcggagagacgcccttccacctctgggagcctcggtctgttggggtcgcggagttcgggcgcggctccgggtacccgagaccagcggcggcaacttctaacacgggagatttcccgccaccccaccccgccgccgcgagtcctcgcggggcgtgttgcgtgcggaggtcaggctgccaccctctgtagttccctaaccccaaactcggagacttctaagagccacaccaccaaggaacttctagtcctggaggtcaatggtggggcaaacctcgcctcaattctttgaccccctcgggtcgtaagcagggctaagaggctgcgaagaagaggcctggccatgggtgtatgggggaagaaacatctcaggctcactcatgccccctccccgaccttctcccacctgccgccatccccgcaggctggggagccaggaatcgacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctggacaagcggcgcccccaggtcgagcggcctctcgctgcctggcagtgcctggcagcccccacctctgccagtgcttcggaaacccgcctggccaggttcgcccgcggtgaaaaatgaaagcaaattccccaacagaggtagccggaactttcctcgacgaaggctccctcctgcgcctgtgtctggagaacccccagagcgctgcaagttagcaagagagattcgatggcggctctggaaggcgcacgaagggtggggcgggggagcaaagaggccactgggtgacccagcctggtccggggtgaaacgctagagaaggcgcctcgccttccttatttcaatgcaactcctcggccccagacggtaaaaatagtttccaagctgccgcggacgcccaggatgtgtttgcagagatcaaactggggaggaggcagctttgtaaaagttgcagaaagattagccgagaagcgtccgcccggcggggctcaagaaagcttggggacagctccatgttccttggggcggaatggcccaagaattggcctgggtaaccccctgcccagttctctgtcctcacttcgagccagtgcttaaataacttcccgccgcctgccctgcaaacttcccggcgcggcgccgttgaggccaggacacagcaaaggctagcaaaaccccgccgcggcgcgctcggccccggccctgagaggctgcgcgggtgggaggaccagtgtggtttctgctcccactcggctgcccagaccctcaagaccgatcccccaactcctgggagcgggtgcttccctctgggagccgagatcttgcggggccagcgagggcgcaaagtgcgcgcgctggcccgcgcgggggcggccgcgcgtctctccgcggggcctgtcgccaggccggccgcggcgcgtgagtgatgagggcagagaagggcgcccataaatcgcgggtgtcagggcgaaaaactctctttattgtctgcgtgatggatgggcccggggacgagacaccaaatacttcgtatcgcctttaaatgggaacacattttccgcggccataattcatgttttttaaatagaaagtttgaaatgttgcctatatttcaccagccctgacatatttatgaatcgctccctgcatgcaaatatcattacttaaagcgccggggagagcgcgggggaggggaggaggcgcggttcccggggcgtgggggtggtgaaccggggaaatatcggtggaggggggccatctccctaaagggcagagggtgaggtgcggtgaatagccgtatccggaaaccgagcgtgccccgggcttctttcccgccgccagaccccgcacagccgccctgggacgtttttcgaggcttgggacctaagacgggtccccggaccctgctgggaaaccagggggcgtttttcgtccctctctgaggccattatccaagctgaaaccaccttttataagaaaaaagtttaaagaaaaaaaatttaacaaacacaaataataataataacccaacatgtttcgcgttctttgccactgcatcgattttattgattttcattctgcaaacctgggaatgtgcgcgctcgggaggggaggctgtcaaaacccagtcatcgcggggactggatgggggacaattctccgacgccgcggcctggacccgcccccacccaaccggcgcaccacctcccaggcaccacggagcctgcgcaagctgcggggccgtaaaggaaccggcccccaatctccggggcttcagtcccgcccctctctccccccagtgccctgcagcgctcccagggtccgtgtctgccctccccaagcccccactgtcaatacaatccctgtt

SEQ ID NO: 282295 - DNA, 2190 bp, Homo sapiens
gtgcggcacgaggagcgggtctggaactgcccttggtatgctcgccctctcctcttggcccatctcactcccctcccccacctgactcccctccccggcttctttctctgtctcccactccgcacgggtaccgagaactttccgggaatcgacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctggacaagcggcgcccccaggtcgagcggcctctcgctgcctggcagtgcctggcagcccccacctctgccagtgcttcggaaacccgcctggccaggttcgcccgcggtgaaaaatgaaagcaaattccccaacagaggtagccggaactttcctcgacgaaggctccctcctgcgcctgtgtctggagaacccccagagcgctgcaagttagcaagagagattcgatggcggctctggaaggcgcacgaagggtggggcgggggagcaaagaggccactgggtgacccagcctggtccggggtgaaacgctagagaaggcgcctcgccttccttatttcaatgcaactcctcggccccagacggtaaaaatagtttccaagctgccgcggacgcccaggatgtgtttgcagagatcaaactggggaggaggcagctttgtaaaagttgcagaaagattagccgagaagcgtccgcccggcggggctcaagaaagcttggggacagctccatgttccttggggcggaatggcccaagaattggcctgggtaaccccctgcccagttctctgtcctcacttcgagccagtgcttaaataacttcccgccgcctgccctgcaaacttcccggcgcggcgccgttgaggccaggacacagcaaaggctagcaaaaccccgccgcggcgcgctcggccccggccctgagaggctgcgcgggtgggaggaccagtgtggtttctgctcccactcggctgcccagaccctcaagaccgatcccccaactcctgggagcgggtgcttccctctgggagccgagatcttgcggggccagcgagggcgcaaagtgcgcgcgctggcccgcgcgggggcggccgcgcgtctctccgcggggcctgtcgccaggccggccgcggcgcgtgagtgatgagggcagagaagggcgcccataaatcgcgggtgtcagggcgaaaaactctctttattgtctgcgtgatggatgggcccggggacgagacaccaaatacttcgtatcgcctttaaatgggaacacattttccgcggccataattcatgttttttaaatagaaagtttgaaatgttgcctatatttcaccagccctgacatatttatgaatcgctccctgcatgcaaatatcattacttaaagcgccggggagagcgcgggggaggggaggaggcgcggttcccggggcgtgggggtggtgaaccggggaaatatcggtggaggggggccatctccctaaagggcagagggtgaggtgcggtgaatagccgtatccggaaaccgagcgtgccccgggcttctttcccgccgccagaccccgcacagccgccctgggacgtttttcgaggcttgggacctaagacgggtccccggaccctgctgggaaaccagggggcgtttttcgtccctctctgaggccattatccaagctgaaaccaccttttataagaaaaaagtttaaagaaaaaaaatttaacaaacacaaataataataataacccaacatgtttcgcgttctttgccactgcatcgattttattgattttcattctgcaaacctgggaatgtgcgcgctcgggaggggaggctgtcaaaacccagtcatcgcggggactggatgggggacaattctccgacgccgcggcctggacccgcccccacccaaccggcgcaccacctcccaggcaccacggagcctgcgcaagctgcggggccgtaaaggaaccggcccccaatctccggggcttcagtcccgcccctctctccccccagtgccctgcagcgctcccagggtccgtgtctgccctccccaagcccccactgtcaatacaatccctgtt

SEQ ID NO: 282296 - DNA, 2778 bp, Homo sapiens
gctggcgcggcggccacgggcgcccagcgcgccttctcggcgcctggagccagacgcgagtaatcctgggtggcccgcagcggagccgtggccgggctagaggagccggctggactgcgggagtgccgggcggctcgcggtgtccgcctcgggctgctcccctgcgctgcgttctcgcggccccgcgccggcgctgcgctctgcgatgcgagccgctgcgtgtccagccggggctctggcgaggaaactcacttcaaaagcagctgcaccaagggggagattaaagcctttgccgccttccaatcaaatgggagcccgaggtgattggagggtcaaggggatgtgacgcgtcccgcgccgccgccgccgccgctgccaggactctcagtgccggttttaatgggcagctccctcttcgccgcccccctgtgtgtcccctccctcgatttcgctgggaggacgagatggacatttattctacgtttgccatccgccgcctccctcttttttcctcctcgtcgttcttcctttccccagctcgaaaataaactgaaaccttcttttgaaggggggtgcgcgtgaggaacagactgcggggggtgtccagaaggagcaccggtgggagtgtggacaccggccggactgtcaactccaggggcgaagggaacctgcacacccagtgttttttccttcgcagtaatcgagatcccgcgcggcgcagcgcagccaccaggaatcgacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctggacaagcggcgcccccaggtcgagcggcctctcgctgcctggcagtgcctggcagcccccacctctgccagtgcttcggaaacccgcctggccaggttcgcccgcggtgaaaaatgaaagcaaattccccaacagaggtagccggaactttcctcgacgaaggctccctcctgcgcctgtgtctggagaacccccagagcgctgcaagttagcaagagagattcgatggcggctctggaaggcgcacgaagggtggggcgggggagcaaagaggccactgggtgacccagcctggtccggggtgaaacgctagagaaggcgcctcgccttccttatttcaatgcaactcctcggccccagacggtaaaaatagtttccaagctgccgcggacgcccaggatgtgtttgcagagatcaaactggggaggaggcagctttgtaaaagttgcagaaagattagccgagaagcgtccgcccggcggggctcaagaaagcttggggacagctccatgttccttggggcggaatggcccaagaattggcctgggtaaccccctgcccagttctctgtcctcacttcgagccagtgcttaaataacttcccgccgcctgccctgcaaacttcccggcgcggcgccgttgaggccaggacacagcaaaggctagcaaaaccccgccgcggcgcgctcggccccggccctgagaggctgcgcgggtgggaggaccagtgtggtttctgctcccactcggctgcccagaccctcaagaccgatcccccaactcctgggagcgggtgcttccctctgggagccgagatcttgcggggccagcgagggcgcaaagtgcgcgcgctggcccgcgcgggggcggccgcgcgtctctccgcggggcctgtcgccaggccggccgcggcgcgtgagtgatgagggcagagaagggcgcccataaatcgcgggtgtcagggcgaaaaactctctttattgtctgcgtgatggatgggcccggggacgagacaccaaatacttcgtatcgcctttaaatgggaacacattttccgcggccataattcatgttttttaaatagaaagtttgaaatgttgcctatatttcaccagccctgacatatttatgaatcgctccctgcatgcaaatatcattacttaaagcgccggggagagcgcgggggaggggaggaggcgcggttcccggggcgtgggggtggtgaaccggggaaatatcggtggaggggggccatctccctaaagggcagagggtgaggtgcggtgaatagccgtatccggaaaccgagcgtgccccgggcttctttcccgccgccagaccccgcacagccgccctgggacgtttttcgaggcttgggacctaagacgggtccccggaccctgctgggaaaccagggggcgtttttcgtccctctctgaggccattatccaagctgaaaccaccttttataagaaaaaagtttaaagaaaaaaaatttaacaaacacaaataataataataacccaacatgtttcgcgttctttgccactgcatcgattttattgattttcattctgcaaacctgggaatgtgcgcgctcgggaggggaggctgtcaaaacccagtcatcgcggggactggatgggggacaattctccgacgccgcggcctggacccgcccccacccaaccggcgcaccacctcccaggcaccacggagcctgcgcaagctgcggggccgtaaaggaaccggcccccaatctccggggcttcagtcccgcccctctctccccccagtgccctgcagcgctcccagggtccgtgtctgccctccccaagcccccactgtcaatacaatccctgtt

SEQ ID NO: 282297 - DNA, 2231 bp, Homo sapiens
tgtgcgcctgccctctcggtgtcggagagacgcccttccacctctgggagcctcggtctgttggggtcgcggagttcgggcgcggctccgggtacccgagaccagcggcggcaacttctaacacgggagatttcccgccaccccaccccgccgccgcgagtcctcgcggggcgtgttgcgtgcggagaatcgacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctggacaagcggcgcccccaggtcgagcggcctctcgctgcctggcagtgcctggcagcccccacctctgccagtgcttcggaaacccgcctggccaggttcgcccgcggtgaaaaatgaaagcaaattccccaacagaggtagccggaactttcctcgacgaaggctccctcctgcgcctgtgtctggagaacccccagagcgctgcaagttagcaagagagattcgatggcggctctggaaggcgcacgaagggtggggcgggggagcaaagaggccactgggtgacccagcctggtccggggtgaaacgctagagaaggcgcctcgccttccttatttcaatgcaactcctcggccccagacggtaaaaatagtttccaagctgccgcggacgcccaggatgtgtttgcagagatcaaactggggaggaggcagctttgtaaaagttgcagaaagattagccgagaagcgtccgcccggcggggctcaagaaagcttggggacagctccatgttccttggggcggaatggcccaagaattggcctgggtaaccccctgcccagttctctgtcctcacttcgagccagtgcttaaataacttcccgccgcctgccctgcaaacttcccggcgcggcgccgttgaggccaggacacagcaaaggctagcaaaaccccgccgcggcgcgctcggccccggccctgagaggctgcgcgggtgggaggaccagtgtggtttctgctcccactcggctgcccagaccctcaagaccgatcccccaactcctgggagcgggtgcttccctctgggagccgagatcttgcggggccagcgagggcgcaaagtgcgcgcgctggcccgcgcgggggcggccgcgcgtctctccgcggggcctgtcgccaggccggccgcggcgcgtgagtgatgagggcagagaagggcgcccataaatcgcgggtgtcagggcgaaaaactctctttattgtctgcgtgatggatgggcccggggacgagacaccaaatacttcgtatcgcctttaaatgggaacacattttccgcggccataattcatgttttttaaatagaaagtttgaaatgttgcctatatttcaccagccctgacatatttatgaatcgctccctgcatgcaaatatcattacttaaagcgccggggagagcgcgggggaggggaggaggcgcggttcccggggcgtgggggtggtgaaccggggaaatatcggtggaggggggccatctccctaaagggcagagggtgaggtgcggtgaatagccgtatccggaaaccgagcgtgccccgggcttctttcccgccgccagaccccgcacagccgccctgggacgtttttcgaggcttgggacctaagacgggtccccggaccctgctgggaaaccagggggcgtttttcgtccctctctgaggccattatccaagctgaaaccaccttttataagaaaaaagtttaaagaaaaaaaatttaacaaacacaaataataataataacccaacatgtttcgcgttctttgccactgcatcgattttattgattttcattctgcaaacctgggaatgtgcgcgctcgggaggggaggctgtcaaaacccagtcatcgcggggactggatgggggacaattctccgacgccgcggcctggacccgcccccacccaaccggcgcaccacctcccaggcaccacggagcctgcgcaagctgcggggccgtaaaggaaccggcccccaatctccggggcttcagtcccgcccctctctccccccagtgccctgcagcgctcccagggtccgtgtctgccctccccaagcccccactgtcaatacaatccctgtt

SEQ ID NO: 282298 - DNA, 1445 bp, Homo sapiens
gcgtcactcgcgaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaagacaagagaaagaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaaccagcgacgtccgcatggccgggagcggcgggtggcctccagggtgtcttataaacgaggagagtgggagtgatgaggctggcagcggctctgattttgagctctcgcagtggagaagcctctgatccctctgatgaggattccgaacctggccctccaaagcagaggaa

SEQ ID NO: 282299 - DNA, 173 bp, Homo sapiens
ctggggacatcttgatgtattggttctctagctggtgacttaaccctattagattacaggatttctatcatatcattagcaaaagaggggggagaaaaaaaagcaaaatttcttattctgtttaagggaaagaaaccttccaaggaaagattgactgcggatccaggaggctc

SEQ ID NO: 282300 - DNA, 2769 bp, Homo sapiens
cggccactgtaaacagcaagcagttgacgggaagactagctctgttgctactaagcagcttttacttttgtaaagtcagctctgttgttttaaatggtaaaaattaaactaatgaacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282301 - DNA, 1184 bp, Homo sapiens
ctcccaacggacacccacccgctcgtcacccggatccccggggccgcagtgacactcggagatcactctgggttcacttaaataggagtactctccccttttccggggaacctgcagagtttggcagcggaaggaaaggtctcccaccaccctcccccggtacgaaacagcggtgaacttgttaggcgccctggtatctcaagaggggcttgcgagttggtgttctgctcatttctggcgctggtgccggattgaacagatgaggaaactgaggtttagacaagcagtgggagttttccatggatttacatctcatttagtggcatttgcaagactagaacttggatcttctgatgtccagtccattgctttgtgtattctgccatcatttcagttctgatagcaatgaggacacatcatggaaactgcaatacacaaaggactgttaagcatgcccccagtgacctgggttctagttctgggactacatttggccgtatgacctgggccatcatatcacttccaagtctcaagtgtctcacatataaaacaaaacgtttgtatgaaattatgttttttctttccaactttagcattttgtgatgtttaccaatgtgtttgtaatccaatgttatcattttctctagaggaaggagacctttgtaccccacatcacctaagagacctagctaattactctttcacctttagtttatcccttcccccctttactacatgccacttcatcaaaggaatgaaacttaacaagtgcgttttagcttaacatctacagtatattgtttagtttactgtttgacttgaaaatattctgaggggttaaagtactgtaaggtacatgtcagggcttacttgaatattctaattgtaagctcataactttttttttttagctttatggtttgcataaagtaagtgctcagtaaatagctgttgaattaatgaagggggtgaatgaagtcattcataaggaaaacatatgctgtaaaacatagaaagcatcttaccatgtaaattcccaacacataagataatttgcctacaggcatgtgcctcctgaagctggcgggtacagagcccattgttgctctcttttctgaaggcatcatatagggaagagcttttctttctccctagacagtagactcatgtcatctatgttatgc

SEQ ID NO: 282302 - DNA, 800 bp, Homo sapiens
agcggattccaagttctaaacagctgagtttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagacacaagtgaaaaaccaaatcctgtctcgtttacccaagattccgtgtacattcattcaagcatggaccaacacagagatgattacgttgctagcctgttattacttcagatcagtttcagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttggtaagaacctgtcatttttc

SEQ ID NO: 282303 - DNA, 2691 bp, Homo sapiens
agcggattccaagttctaaacagctgagtttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282304 - DNA, 2594 bp, Homo sapiens
ctcccaacggacacccacccgctcgtcacccggatccccggggccgcagtgacactcggagatcactctgggttcacttaaataggagtactctccccttttccggggaacctgcagagtttggcagcggaaggaaaggtctcccaccaccctcccccgaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282305 - DNA, 2651 bp, Homo sapiens
gctgaacccaagagactgatgtattgcccagactcctgcacgctgtctgccagccacagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282306 - DNA, 2430 bp, Homo sapiens
ctcgcctgcactgctctcccttcgctgtggggaagcgacaacgtcccgataacttgcagactgtggcgcaactggtcttggtagcggaggcacccgaatgctgcccgggtgagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282307 - DNA, 3085 bp, Homo sapiens
  misc_feature (2880)..(2880): n is a, c, g, or t
ctcgcctgcactgctctcccttcgctgtggggaagcgacaacgtcccgataacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaaaaaaaaaaaaaaaaaaaaaaaaaaaaaaattttggggcgcggccttgggcccctggaaaggtttttaaaaccatttgggtgggggggcggggggccctttgggttcgaggtgacagtgggccacaacagcggtgttctctaaggagaagaaccgcggggacaaggacacaagagngggtgtcggggttttctctcacgcaaaattatacaaacacgggccggggggggacaaaacaggaagctcgttcttctgaaaccaaacgtccgaaagaggggagtacgcggggaggacacatcgagacgggattcttcataaacgagagggagtcgccaagggagaagtgccgaatatcaaatttgagcccgagccgtcggtgtgt

SEQ ID NO: 282308 - DNA, 759 bp, Homo sapiens
ctcgcctgcactgctctcccttcgctgtggggaagcgacaacgtcccgataacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgatgaggaatctgaagctgggatcagcaaagggagatgcccaaggttacacacattggtgggggcagagcctagaccaaacagtggt

SEQ ID NO: 282309 - DNA, 1102 bp, Homo sapiens
cggccactgtaaacagcaagcagttgacgggaagactagctctgttgctactaagcagcttttacttttgtaaagtcagctctgttgttttaaatggtaaaaattaaactaatgaacttgcagactgtggcgcaactggtcttggtagcggaggcacccgaatgctgcccgggtgagatgaggaaactgaggtttagacaagcagtgggagttttccatggatttacatctcatttagtggcatttgcaagactagaacttggatcttctgatgtccagtccattgctttgtgtattctgccatcatttcagttctgatagcaatgaggacacatcatggaaactgcaatacacaaaggactgttaagcatgcccccagtgacctgggttctagttctgggactacatttggccgtatgacctgggccatcatatcacttccaagtctcaagtgtctcacatataaaacaaaacgtttgtatgaaattatgttttttctttccaactttagcattttgtgatgtttaccaatgtgtttgtaatccaatgttatcattttctctagaggaaggagacctttgtaccccacatcacctaagagacctagctaattactctttcacctttagtttatcccttcccccctttactacatgccacttcatcaaaggaatgaaacttaacaagtgcgttttagcttaacatctacagtatattgtttagtttactgtttgacttgaaaatattctgaggggttaaagtactgtaaggtacatgtcagggcttacttgaatattctaattgtaagctcataactttttttttttagctttatggtttgcataaagtaagtgctcagtaaatagctgttgaattaatgaagggggtgaatgaagtcattcataaggaaaacatatgctgtaaaacatagaaagcatcttaccatgtaaattcccaacacataagataatttgcctacaggcatgtgcctcctgaagctggcgggtacagagcccattgttgctctcttttctgaaggcatcatatagggaagagcttttctttctccctagacagtagactcatgtcatctatgttatgc

SEQ ID NO: 282310 - DNA, 412 bp, Homo sapiens
atcatcaaaacagttcagcacaaagaagctgagtttcttcagaagctactgccaggctattacatggtaaggaactgcacatcattaatgcttctacttgaagtttaattactttcctcaacagtttttttctgttgtttttttcagtgactcaggcatgtttctttctctttggtaagctttattctgcatttaaattatgctatgacattcattgaatagattttttaaagtaaactagaactgaatggcagagcatacttgttgaatcccacaatcctgagttcaaatcccagctcagccaataattaactgtgtgaccctgagtaagcagcataactggtcagccttagttccctcagtctttaaaggctgagaaatacgtggccaggcgtggtggctcacgcctgta

SEQ ID NO: 282311 - DNA, 420 bp, Homo sapiens
aaagaagtatatgctatgctgatcattgcagaagaatcccaaacataatgcaccccattttccagacacaagtgattgggagaaataacgaacttatgttgcgactcatggggagaggttacaaattgatgccaaaatctagtctcacacctgcttttttgctccccccagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaacta

SEQ ID NO: 282312 - DNA, 2705 bp, Homo sapiens
ctcgcctgcactgctctcccttcgctgtggggaagcgacaacgtcccgataacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282313 - DNA, 2548 bp, Homo sapiens
ctcgcctgcactgctctcccttcgctgtggggaagcgacaacgtcccgataacttgcagactgtggcgcaactggtcttggtagcggaggcacccgaatgctgcccgggtgagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282314 - DNA, 2654 bp, Homo sapiens
cgaaagcccaccaatccattgtggaatgacctctacaaatagttttgcttctgcacaaccagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282315 - DNA, 2587 bp, Homo sapiens
ctcgcctgcactgctctcccttcgctgtggggaagcgacaacgtcccgataacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 282316 - DNA, 2113 bp, Homo sapiens
ctcgcctgcactgctctcccttcgctgtggggaagcgacaacgtcccgataacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacaggtaatacttagtgcagtcaaataacccatcaggctgttaccacatcaacatcaggcctgaaccagtatctctgaatgaggacacgtctctaacaaccaggatgtgcctgtcatctgcctcataggtcggagagagaacatgcttgatttttactgtggcaaaagaacattggagggaaaaccctcatgatttttctttacagttgatcattatgtcatgtagaaattatatacttggctcaatggaagaagacaaa

SEQ ID NO: 282317 - DNA, 292 bp, Homo sapiens
cggccgcactcgggtgagtccctctcgcctcatccccgcgccccccgcccccgcctcgggggccattgcgagcgggggcctttattagagactttgccccgccggggcctgcagggacaggggcctgggagccgcggcccgccgcgcgcggtgtggggccttggggggcgcccgtgccgcctccccctacccccacccccaccgcctcgccgggtctcgagccccgccggccttggcagtggccgaaacgaggcgatgggggtggggcggcacggacgcggtcgcgggggac

SEQ ID NO: 282318 - DNA, 1894 bp, Homo sapiens
gggaatggaaagtctgagtaacaagacatctccttgcagctgttggaaaccacagacttgtagagactggctctgccttcttcaacatgttcctgtacaaacagtgcacacacatgaacattcattgcatgctcataaataagcctgggaagaactcaccggtccagatgcacacagtatcattgccaagcacaggagaatatagaaatacatgagaatcaggaagtagtatttatttgaatgatggacaattgctaggtaatttggttttatggggtattctggaaatgattatggagaagatggttcagagtatgaaggatcttgtatccaaagttaaggaatttggattttacaggaaggttatgccaatctactgaacgttctaaatatagaagtgattcatatcacttctaaattttggaaagataactctcgttctacaaaaggtgaattagagggagctgggaaggaaggaagggggcgctagccaggagcctaatacacaaatccacttgattgctaatgagggcatgagcagaggcaatgatagctggaacccagaagggtgagatttgtgagatggcggtaaggtagaacacataggattgcaaaaccaattagatttaggggttgagagaggaagcagtcaaaggtttccagattggacaactgtgtgtggcaaagcactaacaaatttcccaccctcagtttttactcaaataactagcaaataccaatatctcataagactactgcaaagttgaatgataaacagttttagtaatgtctttaatatacattgcctctgtcttttggggagtagtatggaggattattctaatttcagtggcaaggttcttgtattttaacattatttaccatcttgcatatgtatagttcatttttcctgtgaaataaaaattatttaatttatgtgaacaagtagaaacatgaacataaatctcacatatggagagggctttctctgtttctgcaaaggatgtgaattgatatcatatatagattcctgtatctgtctgaaatacacagcaatcacagataacaaaattataaacatatctctgtggtttaaattaatgttatttatctcattgactgataagagttgattacaacctgcttgtctgtggcccacctgtcacacagactcagctaaaatgcttgcgaaagatgactatttaaatcttgatattttattcagctggaatatctaatgcagtgttattcaaacatagtctgcagagcaatactgatatgaatggtttgttactagtctgttacaggataaatacagaaatcaagagtaagcatttagaaacttttatagcaataatttgacattgctcaatatgtaagcatgtggacaccattttgttgaacaggatataaatcagtcttgtttttgtctaacttgtgtgatgagtttgagttgtgtactagtcatatgccataggactgtattatcatgtgcgatgttttaaggttattttgaaaactgttatccaaaagtgcataaaatctggaatcattttctttcattgaaagattatttatatttaatcttacagtataagttatttgaactggctacggataaaagactgaagatacattaaaaaaatgtagcactatcagcttcattttggatagcagttaaaaaatatacactgaacttgctgagactggtttaaaaatctcttcctcatttcaatcaacatacctctgtgagcctcctttctctactttgactgctgttaagcaatgtttagaaatagtttagatacacattatcccctgcaaagagcattgccatccattcaaaccagattaggtaaattgacaaccaggaagcaagattaattgtcatatt

SEQ ID NO: 282319 - DNA, 355 bp, Homo sapiens
tttaaaaggagacttgtgaacagcaaagagtagaaagggttctcttacaactgaagcccatggaagacaaatgtgtactgcttggcggataattgcagctttctttcattccctacatgagttcaaatggcagcaaacaaactaggagaacgcagaccttctgacttgtgggtacccctactcatcacctgaagacccttggaaatcaaagccctgacccattaaagacggatggagacagcaacatacgatcatcactattatcttgctttgccccagtccaggttaaccatctgtggtatttttagttgctaagtccatatattcaacataaatcaattatatatccactaaa

SEQ ID NO: 282320 - DNA, 831 bp, Homo sapiens
aaaatactttgagactaaagttagtgaattgcaagctgatagattttgataatctgcagtggaatttgtctttttatctcttaattttaaagacacattaaaaaatcagctgattactattgttttgtaacctttaaagtttaaaaaatatgagccaattaatgatactgccaagtaatatggaaattagacttaattatgcagatataactttctctcttcagaaagatagatgtcacagtgaatttaaaaccagattatttctcttaagtcagctttaggtctttagtagaaatgtgcaatttgtttcaaactacattgccaagcattttctcattcctttttttttttccaggcaagaactgcctccctttgacagatggctaaatttcatggactctcttttaaaattatgtttaactttaccccttctcctaattttagcctaaatccatttaaccttctatctgcaagacttgctctctcccctaatcctttttcccttttcttcccaaaagggtattctttaccccttggcactctttttaccttctctctcattcctcgtgaatgactcctaaatgtttcttcctcattctttctgccctggtagcatgtctgtctttgaggattccatgtagataaaaaatacctccaaggattcccagaccacagtttgggtaacactggttaattaacattttaatttaacataaagcttccaaaattttcccatgccaaatttctatcttctaccattcctattttctcatttgtcctcatgcagggactatcctcacatgtattatttttaatgcagcaaaagaagaa

SEQ ID NO: 282321 - DNA, 375 bp, Homo sapiens
  misc_feature (1)..(2): n is a, c, g, or t
nnaagatcctgtatgaccaggcggtggctcacgctgtaatcccagcactttgagaggccgaggtgggcagatcacctgaggttgggaggagaattgcttgaacccagtaggcagaggttgcggggagccaagatctcgccatgtgcactccatcctggggaacaagagcgaaactccgtctcaaaaaaaaaaaaaagatccctgtggctctgtgcgtggagtagagtgggaagacgagagggatgacaaatgtccaggcaagggagggtgggggcttgggaaaaggtggaggtagcccactaccctccccgactcctgctcctcacctgttttttggccctgctcagctccaggtcaagtgcttgggccagctcc

SEQ ID NO: 282322 - DNA, 1759 bp, Homo sapiens
agacgcaggtgcgttcccgtcgaggctcgcgcagcgggcgtttttggggatcgcctggcgggggtgttcgggagccgcgggctgaagcacgggggcgtgcaggcgcccaggcctcgtgtagtgagggccgagccccgcgccggcttcgctgtagtccgcagcccccggcggctttgtgggcgcagccacgctcctcagccgcccgcccacctgggcctgggccccggttgtttccctgcggtggctgtggtcgttcccgttccagggtctcgagcgcaccgcccctgtgagctcgggctgttcttcctcctccgcgtggctcactccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaggtgttaggataacagccataaatggttgtaagactttgggctcagataagtagacttaagttcaaattttgacttattttacaagtgtgtgatttttggcaagctcatcttcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcctggtgacgtatttgagtcctgaggctggccctcctgttagtcttttctcttactggcttcagccagatggggtctggttttctgttacttgcaacaggaaaaattggaatgatatctatgcatgctattaccgccttatggctgtggtgagattaaaacatgatactgtgggtgaactgcttagtacagtgcctgctattctttatgttggttttaaggtatttttcttgaactttaaagttctaagaaaaattaccgttttaaaattcctaccctctgttcacatgtttaaattttcatgatagtttttctgtctgcatgttttctattcaaaataaattggtcattcttcagttagccacgaagaatattgtgaa

SEQ ID NO: 282323 - DNA, 2190 bp, Homo sapiens
agacgcaggtgcgttcccgtcgaggctcgcgcagcgggcgtttttggggatcgcctggcgggggtgttcgggagccgcgggctgaagcacgggggcgtgcaggcgcccaggcctcgtgtagtgagggccgagccccgcgccggcttcgctgtagtccgcagcccccggcggctttgtgggcgcagccacgctcctcagccgcccgcccacctgggcctgggccccggttgtttccctgcggtggctgtggtcgttcccgttccagggtctcgagcgcaccgccccttcgctgcgctgttagtcgagggcagttttctgggggatcccccgatccccccgcgccgctcaggcgtcttggctcgcggaagcgcaggcgccgactgcctggcgtcgtccgtgactcctggcccttctctgtggatccctttgcttctcgttgcgggttgtgtttcctgcttcgtgggcctggccgtttgcgtttggatgcaggcccgggtgagccctgcgtggcccgctggccttttcctgctccctaggtgactgagccgcgtgtgtgacacatcggagtgaattgaggcaacgcgttcctttccaggcttgcagcgggcggtgtcgttcacgctcctgagcagagccttccggtgctttactcgacgccacaaatagtgcagggttcctcccaggggctgtcgcgagctagaactcttccccgcccctgtgagctcgggctgttcttcctcctccgcgtggctcactccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaggtgttaggataacagccataaatggttgtaagactttgggctcagataagtagacttaagttcaaattttgacttattttacaagtgtgtgatttttggcaagctcatcttcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcctggtgacgtatttgagtcctgaggctggccctcctgttagtcttttctcttactggcttcagccagatggggtctggttttctgttacttgcaacaggaaaaattggaatgatatctatgcatgctattaccgccttatggctgtggtgagattaaaacatgatactgtgggtgaactgcttagtacagtgcctgctattctttatgttggttttaaggtatttttcttgaactttaaagttctaagaaaaattaccgttttaaaattcctaccctctgttcacatgtttaaattttcatgatagtttttctgtctgcatgttttctattcaaaataaattggtcattcttcagttagccacgaagaatattgtgaa

SEQ ID NO: 282324 - DNA, 280 bp, Homo sapiens
atacaatttttccctctctcactccctttcaaaaggcagttgaaagcagacatcagaatgtgggaagagcttgtttcccctttttgaaaacacgttcttgctcatcgactcatcctctccttgggtccccagagatgggcagggcaggtgttatgactaatctcattatacggatgagaagaaacctggggcccggcagggaaagaaacttcctgcagtcccagggcaggtcagcggcagggctgggacccaaccccaggtctcctgtacccaggcagga

SEQ ID NO: 282325 - DNA, 1062 bp, Homo sapiens
aggtgcttcctggttcaccccaccctcagcagagacagaccccagatctgggcccaggactttgtgcagggaggggaaatactggactctgaaatgggcacgtacagagacgaagagaccccaacatgcttcaggctttgagtggagaggacacagcctctgctgggacagggaacagagggatgtggagtccctgaagatgcttttggacaatggtctgaggttgggacagtggcaggagataccattcacccaggatctccaggacaagagatcagcctggcagttacatgtgtttttttttcaaactggttgccaggttggcatgaacgatgacatcagagattccgaccttcctgattggagggaccggactccgtggtgcctggagatcagttggacaacagtatcttctcagagctgttctccactcctgacttctcctaggcttgagaattgataacatactcttctggatcctagcagtgtccagaagaaggccatggacagaacggagactaggttccgtaagaggggacagattacgggaaagatcacgaccagccgtcaaccgcaccgccagaatgagcagagtccccagcggagcacctcggggtaccccctccaggaggtggtggatgatgaagtgttgggaccatcagcccctggggtagatcccagccccccgcataggtccttttgctggaaaaggaagatggagtggtgggacaaatctgaggagtcggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttggtaggaggacaccccagagagcacctccaatcctgttctttccaaaaacaggaaacttccaataaccacacttttccaatgggaaaaataggccccagtgggtgagctctccatgtgggaggaatgtgaagtgatcactcatgagggacacttaggagatgataaaggatta

SEQ ID NO: 282326 - DNA, 281 bp, Homo sapiens
aaggagcggcacatggagctcagcagaggagacagacagaaggaaagatggcttggagaagccagcagtctgcgaggctggggaggatggagagtggtttggggttttgggtcgggctctagtgtgatcaactgcagaagcattacaccgtggcctggtttctttactcagcccctggggtagatcccagccccccgcataggtccttttgctggaaaaggaagatggagtggtgggacaaatctgaggagtcggaggaggagccacggaaggtgctcgcc

SEQ ID NO: 282327 - DNA, 2674 bp, Homo sapiens
  misc_feature (1186)..(1186): n is a, c, g, or t
atacaatttttccctctctcactccctttcaaaaggcagttgaaagcagacatcagaatgtgggaagagcttgtttcccctttttgaaaacacgttcttgctcatcgactcatcctctccttgggtccccagagatgggcagggcaggtgttatgactaatctcattatacggatgagaagaaacctggggcccggcagggaaagaaacttcctgcagtcccagggcaggtcagcggcagggtggaaaaggaagagggagtggtcagatgaatctgaggaggagccggagaaggagctcgcccctgagcctgaggagacctgggtagtggagacgctgtgtgggctcaagatgaagctgaagcaacagcgagtgtcacccatcctccttgagcaccacaaggacttcaacagtcagcttgcccctggggtagatcccagccccccgcataggtccttttgctggaaaaggaagatggagtggtgggacaaatctgaggagtcggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctccttgctatggtcatagcgtatttcagccgagccggcttcccctcctggcaataccaacgccttcatttcttcctggctctctacctggccaatgacatggaggaggacgacgaggactccaaacaaaacatcttccacttcctgtatgggaagaaccgctctcgcatacccttgctccgtaagcgtcggttccagttataccgttccatgaacccgagggccaggaagaaccgctctcacatacccttggtccgtaagcgtcggttccagttacgccgttgcatgaacccgagggccaggaagaaccgctctcagatagtcctgttccagaaacgtcggttccacttcttctgttccatgagctgcagggcttgggtttccccagaggagttggaggagatccaggcttatgacccagagcactgggtgtgggcgcgagatcgcgctcgcctttcctagagctccagggaccntggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggagggggatggggtccttctaggagtccttggagaaaagtaagaaaccaggagtgtttccagttccaccctttcctggggcaccaccaccctttttatattgctgaattccaacctccctggggcggaacctggaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttgagacaattctttttatcctaaatattttatcatctttaaatttgtttctgtattattatatgtgctcctgaagcgagcactctttttatctatgatacttccataataatctcttctatttatagctattggtagttcccctaaattctgacgatagaaatttttatttgctgtttaggtttgtgactgaattgtgagaattcagttgtgatttttaacatgtgtcagatatatatactaacacgtctaatatatactattttattggtttattttgaaaaacatgggtatagaattatttaaatattattttatttatttaaatatttattaaatatatttatttatttaaatgttattattactttaaatattattttaaatattttggaaatactggtatttttgaatagatgctgtttctataaagctgtgtgatggtattataactgttatatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttcatctatgtttgaaatgtgagaattcagatgtaattttttaccttgatttggcatgtttgtatgttactttaaagaggatgtgtgttctaaaggaggacatgagctgtgtgttttcaagagaacaatagagtgtgtctcttggggaaacgtaataaaaatgaacttttctcaccttc

SEQ ID NO: 282328 - DNA, 1597 bp, Homo sapiens
cggcaccctggcgcccggctggcggctggtgaagggcttcctgaaccagccagtggacgtggagttgtaccagggcctgtgggacatgtgtcgcgagcagagcagccgcgagcgcgagtgcggccagacggaccagtggggctacttcgaggcccagcccgtgctggtggcgcgggcactcatggtcacctcgctggccgccacggtcctggggcttctgctggcgtcgctgggcgtgcgctgctggcaggacgagcccaacttcgtgctggcagggctctcgggcgtcgtgctcttcgtcgctggcctcctcggcctcatcccggtgtcctggtacaaccacttcttgggggaccgcgacgtgctgcccgccccggccagcccggtcacggtgcaggtcagctacagcctggtcctgggctacctgggcagctgcctcctgctgctgggcggcttctcgctggcgctcagcttcgcgccctggtgcgacgagcgttgtcgccgccgccgcaagggaccctccgccgggcctcgccgcagcagcgtcagcaccatccaagtggagtggcccgagcccgacctggcgcccgccatcaagtactacagcgacggccagcaccgaccgccgcctgcccagcaccgcaagcccaagaccaagcccaaggtcggcttccccatgccgcggccgcggcccaaggcctacaccaactcggtggacgtcctcgacggggaggggtgggagtcccaggacgctccctcgtgcagcacccacccctgcgacagctcgctgccctgcgactccgacctctagacgcttgtagagcctggggggcgccgggtggcaaaggactcacccccgcacaggcccgcctggcttcgagttggaacccggacacttgcccctcactggtgtggatggaaatctgcctttcgtgggaccaaacaggactccttggacgattagttcaggttgggtttggttttcttcttaaagagtttagttttcctctccagagggatcagggtcctcttagggagtgacgggcttttcatatatttttgctgaagaatatatggaaagggtggcatttgcgtcacgtggaccagggacagtgctgaaatcagcagtgctcagaaacaatttaacatgttgaaacgacaatattcctgctgtataactccttgccatgcaaactctcaagaggccaatatattcctggccatgtttgaatgagcctcttaaaataaacttagagccatgcaaatgccagcagcttaatggatttcatggaatgaaataccgtgattaactcatagctacatatcattgcataaatgggatttatcttttttctcacttatttttgcggtgaaagtcgagggcatgcaagagtttctcttccagaagccaagaggagaacaaaggtcctaatgctgtactattccaccctttggacgcctcatccaggacgcagaggactctaggtttaacattttgtacaaaatggaacctgttaatcatattaaagcacatatgtatatatcttttatttataaataaaattttaaaacaatagtttcagtatagccacaaaag

SEQ ID NO: 282329 - DNA, 1651 bp, Homo sapiens
cggcaccctggcgcccggctggcggctggtgaagggcttcctgaaccagccagtggacgtggagttgtaccagggcctgtgggacatgtgtcgcgagcagagcagccgcgagcgcgagtgcggccagacggaccagtggggctacttcgaggcccagcccgtgctggtggcgcgggcactcatggtcacctcgctggccgccacggtcctggggcttctgctggcgtcgctgggcgtgcgctgctggcaggacgagcccaacttcgtgctggcagggctctcgggcgtcgtgctcttcgtcgctggcctcctcggcctcatcccggtgtcctggtacaaccacttcttgggggaccgcgacgtgctgcccgccccggccagcccggtcacggtgcaggtcagctacagcctggtcctgggctacctgggcagctgcctcctgctgctgggcggcttctcgctggcgctcagcttcgcgccctggtgcgacgagcgttgtcgccgccgccgcaagggaccctccgccgggcctcgccgcagcagcgtcagcaccatccaagtggagtggcccgagcccgacctggcgcccgccatcaagtactacagcgacggccagcaccgaccgccgcctgcccagcaccgcaagcccaagaccaagcccaaggtcggcttccccatgccgcggccgcggcccaaggcctacaccaactcggtggacgtcctcgacggggaggggtgggagtcccaggacgctccctcgtgcagcacccacccctgcgacagctcgctgccctgcgactccgacctctagacgcttgtagagcctggggggcgccgggtggcaaaggactcacccccgcacaggcccgcctggcttcgagttggaacccggacacttgcccctcactggtgtggatggaaatctgcctttcgtgggaccaaacaggactccttggacgattagttcaggttgggtttggttttcttcttaaagagtttagttttcctctccagagggatcagggtcctcttagggagtgacgggcttttcatatatttttgctgaagaatatatggaaagggtggcatttgcgtcacgtggaccagggacagtgctgaaatcagcagtgctcagaaacaatttaacatgttgaaacgacaatattctaaaatactgatgaatcttgcatcaatataattattgggttttttttctttttcctgctgtataactccttgccatgcaaactctcaagaggccaatatattcctggccatgtttgaatgagcctcttaaaataaacttagagccatgcaaatgccagcagcttaatggatttcatggaatgaaataccgtgattaactcatagctacatatcattgcataaatgggatttatcttttttctcacttatttttgcggtgaaagtcgagggcatgcaagagtttctcttccagaagccaagaggagaacaaaggtcctaatgctgtactattccaccctttggacgcctcatccaggacgcagaggactctaggtttaacattttgtacaaaatggaacctgttaatcatattaaagcacatatgtatatatcttttatttataaataaaattttaaaacaatagtttcagtatagccacaaaag

SEQ ID NO: 282330 - DNA, 433 bp, Homo sapiens
agactcgctggctccgccggcgtgccatccgcgccgccagtgggagggtatagctgggtgggaggagatggaaaagtaagtggagcgccctgaagggaaggaaagggatctggagccccatttatttccttcatgaatgtccagaggagatccttgaaatgaagactgccactggatatattgagctgcacacccaaatgccaggattcttcgttgggagtcccaccagttaaagagcagtaagacatgccattgcctacagaaagccgtctacacaggcctaaatcacagggaggcgatgttccaaattttccttaccacttcactgatttttagttttttatcacttcctctaccacaaagaactactcaaagtggctattgatggttagtgtgatcacagatcttagtaatgaattgcatttggaatatg

SEQ ID NO: 282331 - DNA, 3365 bp, Homo sapiens
  misc_feature (60)..(60): n is a, c, g, or t
gaaggagcgggcatgaggcgctgcccgtgccgtgggagcctgaacgaggcggaggccggnggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaa

SEQ ID NO: 282332 - DNA, 739 bp, Homo sapiens
tttctgtgtgtgggaggtagggatcaggttcatttttttccatatggattgttgacccagcactgtttattgaaaagacttccctttccccactgaattgcagtgcctagtcataactgcacaactctacgtgtgtgtctttgtggactctgttgtattctgtgcattgatttgcccattcttgtgccacactgtggctttatgtcttaatatcaggaagggtaagccctccagtttgttctacataatttcctttgtcacatcctctgtgtgctcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaaggtgaggaccaggaaccgcctggcctgtcccgggaaggcctatagccagatcccaggcagggcttcttggggaaagccacgagagagtgcaggagacggcgtgggatgaaaggctggggctggggaagcccagcctctttcttacctccatacccatcagagcccaggttctgtttatccgtctgcctgagcatctcctgagtccatcttttcctcctctccttctccatggtcatgtcctagtccagccccatctt

SEQ ID NO: 282333 - DNA, 2912 bp, Homo sapiens
  misc_feature (48)..(48): n is a, c, g, or t
agcaccaacaacacccaaacgcaatacggcaggtcaggcccctgttantcggatgagggcatgggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaa

SEQ ID NO: 282334 - DNA, 3854 bp, Homo sapiens
  misc_feature (60)..(60): n is a, c, g, or t
gaaggagcgggcatgaggcgctgcccgtgccgtgggagcctgaacgaggcggaggccggnggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaaaaaaaaaacaaaactcacaaaaacaatgacaaaaaaaaaaacaaaataacaaaacaaaaaaaaaaaacaaaacaaaaaacaacagagcggaggagcaaccaaaatagcccacaagagggcgcgaaaaaaacacgagcacacaccaaaatgtactaaaaagaagtcgacacaacacaaggagaccaagacaacacagaaacaagcagagcgcgcgcgaggaatacacacaagcggcggaagacggagagaaccaaaaaacgagagaagcggaccacctcatgtgagagaggaacgaacacaacaaccccgcggggagcagacaaaaaaaggcggaacaacacacagagaacaaaacgaaaagcacacgccgcgagcgagcaaaaaccaaacataacgatgactagcaggaacgaacacaacacgcgcacgaccgactgggggacgagagaaagggggaagacggcggaagcacgaagaaaaaaaaaacag

SEQ ID NO: 282335 - DNA, 2161 bp, Homo sapiens
tttctgtgtgtgggaggtagggatcaggttcatttttttccatatggattgttgacccagcactgtttattgaaaagacttccctttccccactgaattgcagtgcctagtcataactgcacaactctacgtgtgtgtctttgtggactctgttgtattctgtgcattgatttgcccattcttgtgccacactgtggctttatgtcttaatatcaggaagggtaagccctccagtttgttctacataatttcctttgtcacatcctctgtgtgctcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaa

SEQ ID NO: 282336 - DNA, 1943 bp, Homo sapiens
  misc_feature (60)..(60): n is a, c, g, or t
gaaggagcgggcatgaggcgctgcccgtgccgtgggagcctgaacgaggcggaggccggnggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaaggtgaggaccaggaaccgcctggcctgtcccgggaaggcctatagccagatcccaggcagggcttcttggggaaagccacgagagagtgcaggagacggcgtgggatgaaaggctggggctggggaagcccagcctctttcttacctccatacccatcagagcccaggttctgtttatccgtctgcctgagcatctcctgagtccatcttttcctcctctccttctccatggtcatgtcctagtccagccccatctt

SEQ ID NO: 282337 - DNA, 1198 bp, Homo sapiens
  misc_feature (60)..(60): n is a, c, g, or t
gaaggagcgggcatgaggcgctgcccgtgccgtgggagcctgaacgaggcggaggccggnggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctggggtgagtgggacccatcctgcccttgagcca

SEQ ID NO: 282338 - DNA, 677 bp, Homo sapiens
ctcatggggaaccactttgtcagtttcttgtatttcttcctgttagtgccagtaaatggagttgtagatccgaaatgttcctcagtacgcatactgattggtactttgctattttcacttaatagtaacaccctgcagagttttccacatcattccatagaaagcttcctctttctgtttttttttcccccacagctatgtaacactgtttttgtgactgtgcctggtcccctatagacagacacctgggttgtttccattttttgccattagcaggcctcaaagaatcactttgtatataagacattttgcaagtatgcagattgagctgtagatttccagaagcaggactcctgggtcaaagcttaaaggcatgggaaatttgcgagagatgaccaaacttccactctcggtgttatgccactgcccatcccaccagcaatgtatgagaatgcctgttgcagatccgaccatgccattctcctgttcgaaacccttctgtggctccctagtaccttgaagtgaagttccatagcctgtagggccctctaggatctagcctcttctctctcattcttctcttttcttttttttttgagaaagagtctcgctctgtcacccaggctagatgccaagaccagcctgggaagcacagcaagaccccgtctctatttgga

SEQ ID NO: 282339 - DNA, 485 bp, Homo sapiens
ggctcggtccaagatgggtagatggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaaggtgaggaccaggaaccgcctggcctgtcccgggaaggcctatagccagatcccaggcagggcttcttggggaaagccacgagagagtgcaggagacggcgtgggatgaaaggctggggctggggaagcccagcctctttcttacctccatacccatcagagcccaggttctgtttatccgtctgcctgagcatctcctgagtccatcttttcctcctctccttctccatggtcatgtcctagtccagccccatctt

SEQ ID NO: 282340 - DNA, 3029 bp, Homo sapiens
  misc_feature (60)..(60): n is a, c, g, or t
gaaggagcgggcatgaggcgctgcccgtgccgtgggagcctgaacgaggcggaggccggnggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctgctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaa

SEQ ID NO: 282341 - DNA, 2169 bp, Homo sapiens
  misc_feature (60)..(60): n is a, c, g, or t
gaaggagcgggcatgaggcgctgcccgtgccgtgggagcctgaacgaggcggaggccggnggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagctatgtaacactgtttttgtgactgtgcctggtcccctatagacagacacctgggttgtttccattttttgccattagcaggcctcaaagaatcactttgtatataagacattttgcaagtatgcagattgagctgtagatttccagaagcaggactcctgggtcaaagcttaaaggcatgggaaatttgcgagagatgaccaaacttccactctcggtgttatgccactgcccatcccaccagcaatgtatgagaatgcctgttgcagatccgaccatgccattctcctgttcgaaacccttctgtggctccctagtaccttgaagtgaagttccatagcctgtagggccctctaggatctagcctcttctctctcattcttctcttttcttttttttttgagaaagagtctcgctctgtcacccaggctagatgccaagaccagcctgggaagcacagcaagaccccgtctctatttgga

SEQ ID NO: 282342 - DNA, 216 bp, Homo sapiens
gcaggtcccctttcgttccctctcatggcagcacctctagcccctgccttccctggccttggccctgaccccaccctgctctgctccctacagagcaaaccctggaagaagctgaagacagttctgaagtattcaccctttgtggtctccttccgaaaacactacccttgggtccagctttctggacatgctggtaagtggggtggtggtggacag

SEQ ID NO: 282343 - DNA, 416 bp, Homo sapiens
  misc_feature (377)..(377): n is a, c, g, or t
  misc_feature (388)..(388): n is a, c, g, or t
  misc_feature (397)..(397): n is a, c, g, or t
gactataatcctgcttgaagtttgcttagattcctgggaagtctccctattccaaccctttttgagaaatgcccacagctcataacctacctgaggttatttgggtctcaggaaacacacagcacgtgccaatgttccaagaatgaagctctggttcccagcttctgctgctccaacttctatagcagcaaggagaaaagagtaacagacatactgatcacatctaattagaagattttccttaggcaacctgtgttgtgagtgttcttgagctgtatctacataagtcatgggcctttctcatcatctgggcactgtgggactcaggggatacagcaggacacagctatcttttctgggactcaaggaaaacctgnaaaggaagtanaaacaggtnaggcatatttttacgtggg

SEQ ID NO: 282344 - DNA, 830 bp, Homo sapiens
catttcacttcagaggtttattttattgctttcttggaaatacaattaattaaaaagacaatttaagataatttatgcaaatgaaatattgattgaagaaataattacagttggtgggaaaattgccatgttgacattagatattcatatatcattataattttaaaaattattatttttcagtgatagaaactgaacttaaactaagattggaaaaacacaataaagctaggcaaaattttaagtcatcaaataaatgagtaattgaatgaattagttaataaaatcaaatatattctcctggaaggcttataagacatttatttattcatttatcagatgaggacctaatttattactgaggacctaatctacgggaggtgcaaagaagaatgaaatattgtgtctgcctgtgatgcacattgcttaatatgaatactaagaaaaatagtcatctgtttctgttcctgtccccctcactgcaaggtgatttctttggggttctagtactgttttacacatatcacttcctagagtcagtatggtcaataaatacattcaatctcaacagcaggccaaaaatacatctggaggaaaaagtagatgtgtcatatgagaactacaaataaaattcaatgattattcacaggagaaagattgcatagggtgagagtagggagaagaaatgtgcttggctagaggattagcaggtatttaagaagcaatcccagcttttactcgagttcttttcaggcccgttgtcagaaagatttttgtcctatgaacccttaaagccttgaagccctgctaatgtgcttcgattcttgatt

SEQ ID NO: 282345 - DNA, 758 bp, Homo sapiens
gcagtggtcccagggtccaacttgtgctatttggaaatcaagacatgtccagagagggttttcaggaaaaggcttccagtgatgccacatccaaagcttaattgctccactgaaacactggcaacaaaaatcgtcttctcttctccctttgtgaaaaaggctttcacttaatgtggagaaaggtattatataccagggaaatggaactttgtataaatgattttcccccaagaggaactaaagcatttggaaggtatctgaattcagatgaggacctaatttattactgaggacctaatctacgggaggtgcaaagaagaatgaaatattgtgtctgcctgtgatgcacattgcttaatatgaatactaagaaaaatagtcatctgtttctgttcctgtccccctcactgcaagggcacttcaggactgcagcaaagggcatttgatggagtctataacagaaaagaaagtcctcctctggaatttctgactatatttcattggccacaactggattccatggccacccctaactactggggaggctgagaattcaaatgctgaaaattgcaatctccatagtgaaagacacgaagaaagaaattgattgaaatgggttacttaattcaattagcaacactttttctcagcaaaggagctgagaaagaaaatgttttggttcagtcctgggtaggggtgcttgacagtgcttaatatcaccagcactgaaggtaataaatattatctctcttttctat

SEQ ID NO: 282346 - DNA, 745 bp, Homo sapiens
gcagtggtcccagggtccaacttgtgctatttggaaatcaagacatgtccagagagggttttcaggaaaaggcttccagtgatgccacatccaaagcttaattgctccactgaaacactggcaacaaaaatcgtcttctcttctccctttgtgaaaaaggctttcacttaatgtggagaaaggtattatataccagggaaatggaactttgtataaatgattttcccccaagaggaactaaagcatttggaaggtatctgaattcagatgaggacctaatttattactgaggacctaatctacgggaggtgcaaagaagaatgaaatattgtgtctgcctgtgatgcacattgcttaatatgaatactaagaaaaatagtcatctgtttctgttcctgtccccctcactgcaaggtgatttctttggggttctagtactgttttacacatatcacttcctagagtcagtatggtcaataaatacattcaatctcaacagcaggccaaaaatacatctggaggaaaaagtagatgtgtcatatgagaactacaaataaaattcaatgattattcacaggagaaagattgcatagggtgagagtagggagaagaaatgtgcttggctagaggattagcaggtatttaagaagccgggtatttgggtggtctagcaaggccctgatgggaggggcttatggcgctgggaaaccctaaaccgcttgcgggctagcatattttcttgggg

SEQ ID NO: 282347 - DNA, 230 bp, Homo sapiens
  misc_feature (5)..(5): n is a, c, g, or t
gcccnacgcgtccgctcgttaatgtcaataaacaaactaaggccacacaacgcaaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 282348 - DNA, 6712 bp, Homo sapiens
  misc_feature (4704)..(4704): n is a, c, g, or t
  misc_feature (4717)..(4717): n is a, c, g, or t
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagnctgtctcctgacngccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta
